United States Patent 7,745,391 (HUMAN THROMBOSPONDIN POLYPEPTIDE) - sequence listing, part 106

SEQ ID NO: 319004 - DNA, 1881 bp, Homo sapiens
acgcacgtctctcgctttcgcatacttaaggcgtctgttctcggcagcggcggcacagcgaggtcggcagcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaactctatacttctaaggtgccaccaccttctctagtaacttactgtgtagtcttgggtcatttcactcacttttctttttttcttttctttttcttttttttttttgagacagtctccctctgttgcccaggcaggagcgcagtggcgtgatctcctctcaccgcaagctccacttcctgggttcatgccattctcctacctcagcctcccacgtagctgggagtacaggcggccgc

SEQ ID NO: 319005 - DNA, 1847 bp, Homo sapiens
ccaggctggtactggtcccgaagttcgttttgaggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaactctatacttctaaggtgccaccaccttctctagtaacttactgtgtagtcttgggtcatttcactcacttttctttttttcttttctttttcttttttttttttgagacagtctccctctgttgcccaggcaggagcgcagtggcgtgatctcctctcaccgcaagctccacttcctgggttcatgccattctcctacctcagcctcccacgtagctgggagtacaggcggccgc

SEQ ID NO: 319006 - DNA, 1143 bp, Homo sapiens
cccacgcgtcgcccacgcgtccgtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaactctatacttctaaggtgccaccaccttctctagtaacttactgtgtagtcttgggtcatttcactcacttttctttttttcttttctttttcttttttttttttgagacagtctccctctgttgcccaggcaggagcgcagtggcgtgatctcctctcaccgcaagctccacttcctgggttcatgccattctcctacctcagcctcccacgtagctgggagtacaggcggccgc

SEQ ID NO: 319007 - DNA, 1007 bp, Homo sapiens
acgcacgtctctcgctttcgcatacttaaggcgtctgttctcggcagcggcggcacagcgaggtcggcagcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagctaggacacgtgctatcaaaggtggttggatgacgtgagcaatggtgcactacaggggtccacagagcagaattacccggtataacagggaccgggctcacggcaacccagggggcacaacaagggcacgctgacaccgaaaactgggaacgccccacagtccaggaccggcccaacggcgactgcgcacagcaccatgcactcgaggcaacaacgatctgaagccaacacagagaacacgg

SEQ ID NO: 319008 - DNA, 882 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaaaactttcaaagacgactagcacagaaccctctcttttggaaaacataatttgaataaaataatttttaatggattctgaaatttgtcatgttttgaagataactgactccatctaaaagtatgaggtcaaaggatcacgaaacctaagtttaaaaactgcttagagactgaagcttaattaaaaatctttattaaaaattaaaaacattgaaaaatgaaaatatgttcatcattaaagacttttttccccttaagcttaaaataccattcaaaggcaagacattttgttttggctatgattcattttttttacttaaaaataaaacctataccaaacagtaaaaaaaaccaa

SEQ ID NO: 319009 - DNA, 841 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaaaactttcaaagacgactagcacagaaccctctcttttggaaaacataatttgaataaaataatttttaatgga

SEQ ID NO: 319010 - DNA, 834 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggttttgaaacttcacgacgactagacagaacctccacacgacaaccaatatctgcatcaacctactttaccgg

SEQ ID NO: 319011 - DNA, 1100 bp, Homo sapiens
tttcatatgatgaaggaattacaaagaagttagcttttgctgctgaacaaaacacctccaacctctatggcttaggacagcaatttatttaactcatgattctatttgggctgagctcagctgggtggttcttttggacttgactggacttactcatgactgtggtcagctgcaagtcagctaggtagctttgctcatgggatctggctgttagctgaggaaatgagtccaggtgtctttacttatccagcaggctctccttggcttattcctgtagtaaatcagcaaacttacaaggactagagcagatgcttgcaagtagttttgaaacctaagcttggaactggaacattatcagttctgctgcattctttaggtcaaatcaagtaagaaggccaagagggtgaagaaatagattccatctcttgagaggaggagcttcaaagtcacattgcaagggcatggacccaggtagggaaagaacttgtgacacttttgcaatttatcacaggtggtaagagtaacagggaaagctacctagatctgccttcaagagagaactatcctttgtaaagtttcaaatcaacaatatgtctactctgagctgaaattcttatactagtataactgttactgatggtttcattacactgttctaggtagcaaaagttcaggggttgtgatgctgtgatttaaaacaataatattagggttttctgagcttcttcctgaggggcaaggagatctgtggtctcatttttggcatttccacacaacatggccccccaaatcccatgatttctatttctgcttcaaaagaaaaaaccaagagcaccttctgccttgaggctggaagagacatcagtctgtctgggcttgctgaagaagggagaaaaagaacagcaagaagcaactgaacatattgatgaagtacaaaatgaagtagacttaataagccaatgaggagactttgaaaacagaacagaaatataacaaactcggccaactgttttttcagatgaggtctgaattgatagccaaaatcccaaactttggggtaacagcatttgtcaaccatccacaaatgtctgcactgcttg

SEQ ID NO: 319012 - DNA, 1703 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaggcattttctgtctccaatattaaggctttttataactgaatatctattttgtctatgaatatattccttttttgacatttaaacatattcttttattgtgaacatcagcactgcatgccattaaagtatgtactatagagatctgatgagaaacagttcttaccctaaatattttgttatattgtctccattatgaatttataaagacaggaaaatatagttgcctatgttttagggaccactattaaagcttataaatatttgtgtattttcatttagaagtaccatctatgagagtagtttatactgcactgtgtacatgaatggctaatgaatctattttccaactttcccgtgttttatagatatttcttttcactttgagtatcctagagatgggaggatgcctaggaagagtttgttgagaagtggtaccatggtgtagcatggagagcattggaatgcactaggtttgaattttggcataatgtagctatgtgaccctgagcaaatttctctcatctgctcatctgtggaatgaggaaataggagttgaatttgatttttttccttaggtcccttctaggtcttaaatttgcagaagataaacaattactaaaatttcttatgatttgtgctctctgataaaagctaatcaaaactgccccgatatttaaattcctatgcttgctgtctttttataagaataattacatttccagattatctttttagattttttatagctttttagaaatgacatgtaaaattgttttggataagtcatttggcagttaatgaaagatcctattttaattttcttgtgaatgtaaatatatgtgttttcttttctaggtatgaaaactttcaaagacgactagcacagaaccctctcttttggaaaacataatttgaataaaataatttttaatgga

SEQ ID NO: 319013 - DNA, 1331 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatgatatttcttttcactttgagtatcctagagatgggaggatgcctaggaagagtttgttgagaagtggtaccatggtgtagcatggagagcattggaatgcactaggtttgaattttggcataatgtagctatgtgaccctgagcaaatttctctcatctgctcatctgtggaatgaggaaataggagttgaatttgatttttttccttaggtcccttctaggtcttaaatttgcagaagataaacaattactaaaatttcttatgatttgtgctctctgataaaagctaatcaaaactgccccgatatttaaattcctatgcttgctgtctttttataagaataattacatttccagattatctttttagattttttatagctttttagaaatgacatgtaaaattgttttggataagtcatttggcagttaatgaaagatcctattttaattttcttgtgaatgtaaatatatgtgttttcttttctaggtatgaaaactttcaaagacgactagcacagaaccctctcttttggaaaacataatttgaataaaataatttttaatgga

SEQ ID NO: 319014 - DNA, 946 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatgatatttcttttcactttgagtatcctagagatgggaggatgcctaggaagagtttgttgagaagtggtaccatggtgtagcatggagagcattggaatgcactaggtatgaaaactttcaaagacgactagcacagaaccctctcttttggaaaacataatttgaataaaataatttttaatgga

SEQ ID NO: 319015 - DNA, 1015 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctgttctaagaagccagaaagataagttggagatgactagcctcataaagtttgtctcttgaatgactgggagacccctgtggtgatggtggtaattcataatcctggtgagataattttgccctgctcttaatagggaaaaaggacaaacctggaatgattgtgtgactcagacgagtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaaaactttcaaagacgactagcacagaaccctctcttttggaaaacataatttgaataaaataatttttaatgga

SEQ ID NO: 319016 - DNA, 2180 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggtaattattgaacatctacttgctgcctactttcaacatctgcatgtgtgtgtgaatattaaatatcacaccaagacattgttcagaggagacagaatagtgagctgagataaatgagaatctctctatggaagattagactggagcatgaacttgaaatatgagagaaggaagccaacatccttttggagccatgaatattgtccgaactccatctgttgctcagattggaatttcagtggaattattagacagtatggctcagcagactcctgtaggtaatgctgctgtatcctcagttgactcattcactcaggtaaaagacttcttagagatggttactattttatatgagaaaataggttgatttgaggagagtgataattgaggagggacatagtggatgcagacatggagatgaaagaaaatattttgaagaaaaatttttttctttttttttccccaaaggcctcactatgttgcacaggctggtcttgaatgcctggcctcaagtgattctcctgcctcagcctcccaaagttttgggattacaggcatgagccaccgcacccagccagctttcagcattagactctcttagaactgacactccctataaacaagttaatttcacacaaaagatgttggacaatttctacaattttgcttcatcatttgctgtctctcaggcccagatgacaccaagcccatctgaaatgttcattccggcaaatgtggttctgaaatggtatgaggcattttctgtctccaatattaaggctttttataactgaatatctattttgtctatgaatatattccttttttgacatttaaacatattcttttattgtgaacatcagcactgcatgccattaaagtatgtactatagagatctgatgagaaacagttcttaccctaaatattttgttatattgtctccattatgaatttataaagacaggaaaatatagttgcctatgttttagggaccactattaaagcttataaatatttgtgtattttcatttagaagtaccatctatgagagtagtttatactgcactgtgtacatgaatggctaatgaatctattttccaactttcccgtgttttatagatatttcttttcactttgagtatcctagagatgggaggatgcctaggaagagtttgttgagaagtggtaccatggtgtagcatggagagcattggaatgcactaggtttgaattttggcataatgtagctatgtgaccctgagcaaatttctctcatctgctcatctgtggaatgaggaaataggagttgaatttgatttttttccttaggtcccttctaggtcttaaatttgcagaagataaacaattactaaaatttcttatgatttgtgctctctgataaaagctaatcaaaactgccccgatatttaaattcctatgcttgctgtctttttataagaataattacatttccagattatctttttagattttttatagctttttagaaatgacatgtaaaattgttttggataagtcatttggcagttaatgaaagatcctattttaattttcttgtgaatgtaaatatatgtgttttcttttctaggtatgaaaactttcaaagacgactagcacagaaccctctcttttggaaaacataatttgaataaaataatttttaatgga

SEQ ID NO: 319017 - DNA, 1060 bp, Homo sapiens
tttcatatgatgaaggaattacaaagaagttagcttttgctgctgaacaaaacacctccaacctctatggcttaggacagcaatttatttaactcatgattctatttgggctgagctcagctgggtggttcttttggacttgactggacttactcatgactgtggtcagctgcaagtcagctaggtagctttgctcatgggatctggctgttagctgaggaaatgagtccaggtgtctttacttatccagcaggctctccttggcttattcctgtagtaaatcagcaaacttacaaggactagagcagatgcttgcaagtagttttgaaacctaagcttggaactggaacattatcagttctgctgcattctttaggtcaaatcaagtaagaaggccaagagggtgaagaaatagattccatctcttgagaggaggagcttcaaagtcacattgcaagggcatggacccaggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaaaactttcaaagacgactagcacagaaccctctcttttggaaaacataatttgaataaaataatttttaatgga

SEQ ID NO: 319018 - DNA, 1827 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctgagacaggatcttactctgttttccaggctggagtgcaatgtccacattatagctcactatagcttcaaactcctgggctcaagccatcctcctgccttagcctcctgagtagctaggactacaggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaggcattttctgtctccaatattaaggctttttataactgaatatctattttgtctatgaatatattccttttttgacatttaaacatattcttttattgtgaacatcagcactgcatgccattaaagtatgtactatagagatctgatgagaaacagttcttaccctaaatattttgttatattgtctccattatgaatttataaagacaggaaaatatagttgcctatgttttagggaccactattaaagcttataaatatttgtgtattttcatttagaagtaccatctatgagagtagtttatactgcactgtgtacatgaatggctaatgaatctattttccaactttcccgtgttttatagatatttcttttcactttgagtatcctagagatgggaggatgcctaggaagagtttgttgagaagtggtaccatggtgtagcatggagagcattggaatgcactaggtttgaattttggcataatgtagctatgtgaccctgagcaaatttctctcatctgctcatctgtggaatgaggaaataggagttgaatttgatttttttccttaggtcccttctaggtcttaaatttgcagaagataaacaattactaaaatttcttatgatttgtgctctctgataaaagctaatcaaaactgccccgatatttaaattcctatgcttgctgtctttttataagaataattacatttccagattatctttttagattttttatagctttttagaaatgacatgtaaaattgttttggataagtcatttggcagttaatgaaagatcctattttaattttcttgtgaatgtaaatatatgtgttttcttttctaggtatgaaaactttcaaagacgactagcacagaaccctctcttttggaaaacataatttgaataaaataatttttaatgga

SEQ ID NO: 319019 - DNA, 1465 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaggcattttctgtctccaatattaaggctttttataactgaatatctattttgtctatgaatatattccttttttgacatttaaacatattcttttattgtgaacatcagcactgcatgccattaaagtatgtactatagagatctgatgagaaacagttcttaccctaaatattttgttatattgtctccattatgaatttataaagacaggaaaatatagttgcctatgttttagggaccactattaaagcttataaatatttgtgtattttcatttagaagtaccatctatgagagtagtttatactgcactgtgtacatgaatggctaatgaatctattttccaactttcccgtgttttatagatatttcttttcactttgagtatcctagagatgggaggatgcctaggaagagtttgttgagaagtggtaccatggtgtagcatggagagcattggaatgcactaggtttgaattttggcataatgtagctatgtgaccctgagcaaatttctctcatctgctcatctgtggaatgaggaaataggagttgaatttgatttttttccttaggtcccttctaggtcttaaatttgcagaagataaacaattactaaaatttcttatgatttgtgctctctgataaaagctaatcaaaactgccccgatatttaaattcctatgcttgctgtctttttataagaataattacatttccagattatctttttagattttttatagctttttagaaatgacatgtaaaattgttttggataagtcatttggcagttaatgaaagatcctattttaattttcttgtgaatgtaaatatatgtgttttcttttctaggtatgaaaactttcaaagacgactagcacagaaccctctcttttggaaaacataatttgaataaaataatttttaatgga

SEQ ID NO: 319020 - DNA, 1154 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcaggtaaaagacttcttagagatggttactattttatatgagaaaataggttgatttgaggagagtgataattgaggagggacatagtggatgcagacatggagatgaaagaaaatattttgaagaaaaatttttttctttttttttccccaaaggcctcactatgttgcacaggctggtcttgaatgcctggcctcaagtgattctcctgcctcagcctcccaaagttttgggattacaggcatgagccaccgcacccagccagctttcagcattagactctcttagaactgacactccctataaacaagttaatttcacacaaaagatgttggacaatttctacaattttgcttcatcatttgctgtctctcaggcccagatgacaccaagcccatctgaaatgttcattccggcaaatgtggttctgaaatggtatgaaaactttcaaagacgactagcacagaaccctctcttttggaaaacataatttgaataaaataatttttaatgga

SEQ ID NO: 319021 - DNA, 603 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaaaactttcaaagacgactagcacagaaccctctcttttggaaaacataatttgaataaaataatttttaatgga

SEQ ID NO: 319022 - DNA, 987 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatgatatttcttttcactttgagtatcctagagatgggaggatgcctaggaagagtttgttgagaagtggtaccatggtgtagcatggagagcattggaatgcactaggtatgaaaactttcaaagacgactagcacagaaccctctcttttggaaaacataatttgaataaaataatttttaatggattctgaaatttgtcatgttttgaagataactgactccatctaaaagtatgaggtcaaaggatcacgaaacctaagtttaaaaactgcttagagactgaagcttaattaaaaatctttattaaaaattaaaaacattgaaaaatgaaaatatgttcatcattaaagacttttttccccttaagcttaaaataccattcaaaggcaagacattttgttttggctatgattcattttttttacttaaaaataaaacctataccaaacagtaaaaaaaaccaa

SEQ ID NO: 319023 - DNA, 371 bp, Homo sapiens
gattaggaaacagaggaaatggaatagtgctgcctttatcttctttccagcaatggaaataaccagttgctcctttataatatgtaaactcttatctttctggcaggtaaaagacttcttagagatggttactattttatatgagaaaataggttgatttgaggagagtgataattgaggagggacatagtggatgcagacatggagatgaaagaaaatattttgaagaaaaatttttttctttttttttccccaaagtgagtagcatatttcacagtgtcattgtatgtatgattactcttaacattcttttttattcatttatttaattttatttttttgacacagggcctcactatgttgcacaggct

SEQ ID NO: 319024 - DNA, 331 bp, Homo sapiens
gctttttaaaatgttgcagtccctttgctgaattgtctttttttcccatcaagttttgataatgtattgtattctgtacatatacagttctaagaagccagaaagataagttggagatgactagcctcataaagtttgtctcttgaatgactgggagacccctgtggtgatggtggtaattcataatcctggtgagataattttgccctgctcttaatagggaaaaaggacaaacctggaatgattgtgtgactcagacgagtgagtgttattaatgaatgacattaaaattgtgtttcttaaagaataaaaagcctatttggaatccatg

SEQ ID NO: 319025 - DNA, 1120 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaaaactttcaaagacgactagcacagaaccctctcttttggaaaacataatttgaataaaataatttttaatggattctgaaatttgtcatgttttgaagataactgactccatctaaaagtatgaggtcaaaggatcacgaaacctaagtttaaaaactgcttagagactgaagcttaattaaaaatctttattaaaaattaaaaacattgaaaaatgaaaatatgttcatcattaaagacttttttccccttaagcttaaaataccattcaaaggcaagacattttgttttggctatgattcattttttttacttaaaaataaaacctataccaaacagtaaaaaaaaccaa

SEQ ID NO: 319026 - DNA, 1982 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaggcattttctgtctccaatattaaggctttttataactgaatatctattttgtctatgaatatattccttttttgacatttaaacatattcttttattgtgaacatcagcactgcatgccattaaagtatgtactatagagatctgatgagaaacagttcttaccctaaatattttgttatattgtctccattatgaatttataaagacaggaaaatatagttgcctatgttttagggaccactattaaagcttataaatatttgtgtattttcatttagaagtaccatctatgagagtagtttatactgcactgtgtacatgaatggctaatgaatctattttccaactttcccgtgttttatagatatttcttttcactttgagtatcctagagatgggaggatgcctaggaagagtttgttgagaagtggtaccatggtgtagcatggagagcattggaatgcactaggtttgaattttggcataatgtagctatgtgaccctgagcaaatttctctcatctgctcatctgtggaatgaggaaataggagttgaatttgatttttttccttaggtcccttctaggtcttaaatttgcagaagataaacaattactaaaatttcttatgatttgtgctctctgataaaagctaatcaaaactgccccgatatttaaattcctatgcttgctgtctttttataagaataattacatttccagattatctttttagattttttatagctttttagaaatgacatgtaaaattgttttggataagtcatttggcagttaatgaaagatcctattttaattttcttgtgaatgtaaatatatgtgttttcttttctaggtatgaaaactttcaaagacgactagcacagaaccctctcttttggaaaacataatttgaataaaataatttttaatggattctgaaatttgtcatgttttgaagataactgactccatctaaaagtatgaggtcaaaggatcacgaaacctaagtttaaaaactgcttagagactgaagcttaattaaaaatctttattaaaaattaaaaacattgaaaaatgaaaatatgttcatcattaaagacttttttccccttaagcttaaaataccattcaaaggcaagacattttgttttggctatgattcattttttttacttaaaaataaaacctataccaaacagtaaaaaaaaccaa

SEQ ID NO: 319027 - DNA, 926 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatgtatcctagagatgggaggatgcctaggaagagtttgttgagaagtggtaccatggtgtagcatggagagcattggaatgcactaggtatgaaaactttcaaagacgactagcacagaaccctctcttttggaaaacataatttgaataaaataatttttaatgga

SEQ ID NO: 319028 - DNA, 1867 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggtaattattgaacatctacttgctgcctactttcaacatctgcatgtgtgtgtgaatattaaatatcacaccaagacattgttcagaggagacagaatagtgagctgagataaatgagaatctctctatggaagattagactggagcatgaacttgaaatatgagagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaggcattttctgtctccaatattaaggctttttataactgaatatctattttgtctatgaatatattccttttttgacatttaaacatattcttttattgtgaacatcagcactgcatgccattaaagtatgtactatagagatctgatgagaaacagttcttaccctaaatattttgttatattgtctccattatgaatttataaagacaggaaaatatagttgcctatgttttagggaccactattaaagcttataaatatttgtgtattttcatttagaagtaccatctatgagagtagtttatactgcactgtgtacatgaatggctaatgaatctattttccaactttcccgtgttttatagatatttcttttcactttgagtatcctagagatgggaggatgcctaggaagagtttgttgagaagtggtaccatggtgtagcatggagagcattggaatgcactaggtttgaattttggcataatgtagctatgtgaccctgagcaaatttctctcatctgctcatctgtggaatgaggaaataggagttgaatttgatttttttccttaggtcccttctaggtcttaaatttgcagaagataaacaattactaaaatttcttatgatttgtgctctctgataaaagctaatcaaaactgccccgatatttaaattcctatgcttgctgtctttttataagaataattacatttccagattatctttttagattttttatagctttttagaaatgacatgtaaaattgttttggataagtcatttggcagttaatgaaagatcctattttaattttcttgtgaatgtaaatatatgtgttttcttttctaggtatgaaaactttcaaagacgactagcacagaaccctctcttttggaaaacataatttgaataaaataatttttaatgga

SEQ ID NO: 319029 - DNA, 696 bp, Homo sapiens
  misc_feature (1)..(2): n is a, c, g, or t
  misc_feature (20)..(20): n is a, c, g, or t
  misc_feature (23)..(23): n is a, c, g, or t
  misc_feature (29)..(29): n is a, c, g, or t
nnttcagcttgcactcgcanatntgggcnagttcttggggcgagagaatccattccatctcttgagaggaggagcttcaaagtcacattgcaagggcatggacccaggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaaaactttcaaagacgactagcacagaaccctctcttttggaaaacataatttgaataaaataatttttaatgga

SEQ ID NO: 319030 - DNA, 799 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttcttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctttcacacaaaagatgttggacaatttctacaattttgcttcatcatttgctgtctctcaggcccagatgacaccaagcccatctgaaatgttcattccggcaaatgtggttctgaaatggtatgaaaactttcaaagacgactagcacagaaccctctcttttggaaaacataatttgaataaaataatttttaatgga

SEQ ID NO: 319031 - DNA, 5873 bp, Homo sapiens
  misc_feature (4646)..(4646): n is a, c, g, or t
  misc_feature (4844)..(4844): n is a, c, g, or t
  misc_feature (5492)..(5492): n is a, c, g, or t
  misc_feature (5620)..(5620): n is a, c, g, or t
ggagcctaccataagcacctcatggaactcgctcttcagcaaacatatcaggacacctgtaattgcatcaagtcgcggatcaagttggaatttgaaaaacgtcaacaggagcggcttctgctctccctgctgccggcccacatcgccatggagatgaaagcggagatcatccagaggctgcagggccccaaggcgggccagatggagaacacaaataacttccacaacctgtatgtgaagcggcatacaaacgtgagcatcttatacgctgacatcgttggctttacccggctggcaagtgactgctccccgggagaactagtccacatgctgaatgagctctttggaaagtttgatcaaattgcaaaggagaatgaatgcatgagaattaaaattttaggagactgctactactgtgtatctggactccctatatctctccctaaccatgccaagaactgtgtgaaaatggggctggacatgtgtgaagccataaagaaagtgagggatgctactggagttgatatcaacatgcgcgtgggcgtgcattctgggaatgtcctgtgtggcgtgattggtctgcagaagtggcaatatgatgtgtggtcacatgatgtgaccttggccaaccacatggaagctggaggggtccctggacgtgttcacatttcttctgtcaccctggagcacttgaatggcgcttataaagtggaggagggagatggtgacattagggacccatatttaaaacagcacctggtgaaaacctactttgtgatcaaccccaagggagaacgacggagcccccagcatctcttcagacctcgccacacccttgatggagccaaaatgagggcctcggtccgcatgacccggtacttggagtcctggggggcagccaagccctttgcacacctacatcacagggacagcatgaccacagagaacggcaagatcagcaccacggatgtacccatgggtcagcataattttcaaaatcgcaccttaagaaccaagtcacaaaagaagagatttgaagaagaattgaatgaaaggatgattcaagcaattgatgggattaatgcacagaagcaatggctcaagtctgaagacattcagagaatctcactgcttttctataacaaagtactagaaaaagagtaccgggccacggcactgccagcgttcaagtattatgtgacttgtgcctgtctcatattcttctgcatcttcattgtgcagattctcgtgctgccaaaaacgtctgtcctgggcatctcctttggggctgcgtttctcttgctggccttcatcctcttcgtctgctttgctggacagcttctgcaatgcagcaaaaaagcctctcccctgctcatgtggcttttgaagtcctcgggcatcattgccaaccgcccctggccacggatctctctcacgatcatcaccacagccatcatattaatgatggccgtgttcaacatgtttttcctgagtgactcagaggaaacaatccctccaactgccaacacaacaaacacaagcttttcagcctcaaataatcaggtggcgattctgcgtgcgcagaatttatttttcctcccgtactttatctacagctgcattctgggactgatatcctgttccgtgttcctgcgggtaaactatgagctgaagatgttgatcatgatggtggccttggtgggctacaacaccatcctactccacacccacgcccacgtcctgggcgactacagccaggtcttatttgagagaccaggcatttggaaagacctgaagaccatgggctctgtgtctctctctatattcttcatcacactgcttgttctgggtagacagaatgaatattactgtaggttagacttcttatggaagaacaaattcaaaaaagagcgggaggagatagagaccatggagaacctgaaccgcgtgctgctggagaacgtgcttcccgcgcacgtggctgagcacttcctggccaggagcctgaagaatgaggagctataccaccagtcctatgactgcgtctgcgtcatgtttgcctccattccggatttcaaagaattttatacagaatccgacgtgaacaaggagggcttggaatgccttcggctcctgaacgagatcatcgctgactttgatgatcttctttccaagccaaaattcagtggagttgaaaagattaagaccattggcagcacatacatggcagcaacaggtctgagcgctgtgcccagccaggagcactcccaggagcccgagcggcagtacatgcacattggcaccatggtggagtttgcttttgccctggtagggaagctggatgccatcaacaagcactccttcaacgacttcaaattgcgagtgggtattaaccatggacctgtgatagctggtgtgattggagctcagaagccacaatatgatatctggggcaacactgtcaatgtggccagtaggatggacagcaccggagtcctggacaaaatacaggttaccgaggagacgagcctcgtcctgcagaccctcggatacacgtgcacctgtcgaggaataatcaacgtgaaaggaaagggggacctgaagacgtactttgtaaacacagaaatgtcaaggtccctttcccagagcaacgtggcatcctgaagagtcaccttcattttggcaagaagactgtattttcaggaaggtatcacacactttctgactgcaacttctgtcccttgtttttgatgtgcgtgctgtctgtcctatggagcctctgcagactcgttctcgtgacccagtggcataccgtttggtgtctgatgtgtgcccagatcgttctgccacttgcactgtgcttgctcctaagcaaaagggaaaaggagcgcgcgtgatagaagaaaagcactgggagaactaacagaggagaaaggtgaaacacacacacattcttaaggcaataaaactagggggtgtatattatcttctggtgcatgttcttttctggaaaatatggtagctcgccaaccgcatctgctcatctgatattcaaacacacagtattcgtgaataagttgattctgtcccccacgtggactctgtgctcacccattgtctcattgccagtggtgtccaagggcccccgttgggacccacggctctcgtccctctgctccgtgtgtctcatgccagcagcacgtcgccatccgtcaccagaattagtcctcacagcctaggaccagttttgtatcaaactcgtctgatgttttgatgccatttgtcttttgtaaagttaattcattaaaagttttatgtactttgatttacagtgcctgtatcttttattttcctgtcttctttctcctgtggtttgctccagaattaaggtttgttttccatccattctcccttttgacacagttgtttcagaaagagctctccagaagccaatattgagatgtaattcagattaggacacagtgtgtgacgcagataactggttactcagctccctggaaagcaggcaagcatgttgaatgtatctagtggtctgattttaatttgggcatctctagagaacgctttcagggaaaaatactttaatagtaaaaagattctctgcgagcaacagtgccccctccgtccactacgctcctgtctccaagaatgttttgctagagctaacagacatagactgcaaaagaataatttggaatcagctatgcaaatcagtctcacaatagcgtgagctaactgagagaagtactaagacccacaaactgcctgttaagtctgagaaggctaaagaagacacacagccaacgttcatgcatttttaaagacagaaggccttgaagaatttgttcttgtaaatccaacacaagttgtttggtacttttaacataaagaaatcatactttgccaaatagtgaaaagtagagcaatcgtgtataagctaatgtttaaaagcaaaactgcaaattgtagcccagttggtcaaacttgttttctttttataactcatggcaggcatctgtaagaagtagagaacccagatgatctcttaggaagccttttattcgtgggaactcgaacttgaagcacaagttcctggtttgaatcctggctctgattttttactggctgtgtgactttgaacacatctcttagtccctcttaggagtactttccttattggcaacttatggactcgctagtgattaaacgaggcaatgactgtgagcgagcctggcaggtgccccgtggtacattcacagcacgggcacagctgctgtgccaggactgtgactcattcccagtaaaaggcacttatcgaagctgataaccgtccttcatcaccgaagtgtgagtagagcatgacttatttagtattctgcctcaatggggaattttttgatcctgtaatcacaactcagcattggccttaatatacctaaatctccaaaaacagtgattaaagcaagagaattattacaagggcttttctctttcctctaactcattcttcacggatgccgtagcgtttccgtgagctcaaactggccttggtgtaaaatgtgtaaggatgagcagcaggcgtgcctcgtgggttcttcctctgttacatcctgctacactcatcngcaggtcaccttagttcacctaccctgagtgaacacccccagctgggtggtccaccaagttctcataaacagagtccctcccattcccccacggggtgcaccgaacttgggtttgcgctaaaaagaactcaaaaggagaactgtgctctcccaaagccatatcaccagtcttaccaaacaataggcttttaaaagcantgagtcattgtcagaatccactatgggaagctctgtgtgtacctggtcccttctaggtgtggtcccataggagcagccttagcatcccctgtgaacttatcaaaaatgcaaattctcaggccccaacctgaaggaggaccctgaatttgagatccccggggctggggcccagcacaactgctgtttagtgaacaggttctccaggtgattctgatccctgatcaagcttcagacctccctccctccccagtgtttttgcaggtgaggaaacaggggcagagtaattcaggcacatgtgttcagagttccacagttgattagcagttgaggccaggctagaatggaaaactgcctgttccttgaatctgaaagagcattattcctggtcaaagctccttaaagttctgggcagctaaaagcatccctgtgagcaaaaatgccaggcagaaaactggcagtgcacctctcatcagcccaggtcccagtgccattggcttcaagaaaaaaaaaaatctctccccaatgctctccttaacctttaagtcttacaggaagcctctcatagaaattgcctccagtccagtttcccaaaaaccccagtgttttacatatctgtttaggagtgtctaagttttgtcatcaatccangatgttattcttccttcccaactcactgtgctcctaaaggcagcaaccattcatctttcctttgctctggatacaccgaatgaccaggtaacatcatcaggccgggtgcagtggctcctataatcccnatattttgggaggccgaggagagaggatcacttaagcccaggagtctgagaccagcctgggcaacatagcaagacccccatctctgcaaaaaaataagaaaattagcttggcatggtggcacgtgcctgtagtcccagctacatgggaggctgaggtgggaggatcacttgagcccaggaagtccagaacgtagtgagccttgattataccactgcactccagcctgggtgacagagcgagactctgtctcag

SEQ ID NO: 319032 - DNA, 3325 bp, Homo sapiens
ggagcctaccataagcacctcatggaactcgctcttcagcaaacatatcaggacacctgtaattgcatcaagtcgcggatcaagttggaatttgaaaaacgtcaacaggagcggcttctgctctccctgctgccggcccacatcgccatggagatgaaagcggagatcatccagaggctgcagggccccaaggcgggccagatggagaacacaaataacttccacaacctgtatgtgaagcggcatacaaacgtgagcatcttatacgctgacatcgttggctttacccggctggcaagtgactgctccccgggagaactagtccacatgctgaatgagctctttggaaagtttgatcaaattgcaaaggagaatgaatgcatgagaattaaaattttaggagactgctactactgtgtatctggactccctatatctctccctaaccatgccaagaactgtgtgaaaatggggctggacatgtgtgaagccataaagaaagtgagggatgctactggagttgatatcaacatgcgcgtgggcgtgcattctgggaatgtcctgtgtggcgtgattggtctgcagaagtggcaatatgatgtgtggtcacatgatgtgaccttggccaaccacatggaagctggaggggtccctggacgtgttcacatttcttctgtcaccctggagcacttgaatggcgcttataaagtggaggagggagatggtgacattagggacccatatttaaaacagcacctggtgaaaacctactttgtgatcaaccccaagggagaacgacggagcccccagcatctcttcagacctcgccacacccttgatggagccaaaatgagggcctcggtccgcatgacccggtacttggagtcctggggggcagccaagccctttgcacacctacatcacagggacagcatgaccacagagaacggcaagatcagcaccacggatgtacccatgggtcagcataattttcaaaatcgcaccttaagaaccaagtcacaaaagaagagatttgaagaagaattgaatgaaaggatgattcaagcaattgatgggattaatgcacagaagcaatggctcaagtctgaagacattcagagaatctcactgcttttctataacaaagtactagaaaaagagtaccgggccacggcactgccagcgttcaagtattatgtgacttgtgcctgtctcatattcttctgcatcttcattgtgcagattctcgtgctgccaaaaacgtctgtcctgggcatctcctttggggctgcgtttctcttgctggccttcatcctcttcgtctgctttgctggacagcttctgcaatgcagcaaaaaagcctctcccctgctcatgtggcttttgaagtcctcgggcatcattgccaaccgcccctggccacggatctctctcacgatcatcaccacagccatcatattaatgatggccgtgttcaacatgtttttcctgagtgactcagaggaaacaatccctccaactgccaacacaacaaacacaagcttttcagcctcaaataatcaggtggcgattctgcgtgcgcagaatttatttttcctcccgtactttatctacagctgcattctgggactgatatcctgttccgtgttcctgcgggtaaactatgagctgaagatgttgatcatgatggtggccttggtgggctacaacaccatcctactccacacccacgcccacgtcctgggcgactacagccaggtcttatttgagagaccaggcatttggaaagacctgaagaccatgggctctgtgtctctctctatattcttcatcacactgcttgttctgggtagacagaatgaatattactgtaggttagacttcttatggaagaacaaattcaaaaaagagcgggaggagatagagaccatggagaacctgaaccgcgtgctgctggagaacgtgcttcccgcgcacgtggctgagcacttcctggccaggagcctgaagaatgaggagctataccaccagtcctatgactgcgtctgcgtcatgtttgcctccattccggatttcaaagaattttatacagaatccgacgtgaacaaggagggcttggaatgccttcggctcctgaacgagatcatcgctgactttgatgatcttctttccaagccaaaattcagtggagttgaaaagattaagaccattggcagcacatacatggcagcaacaggtctgagcgctgtgcccagccaggagcactcccaggagcccgagcggcagtacatgcacattggcaccatggtggagtttgcttttgccctggtagggaagctggatgccatcaacaagcactccttcaacgacttcaaattgcgagtgggtattaaccatggacctgtgatagctggtgtgattggagctcagaagccacaatatgatatctggggcaacactgtcaatgtggccagtaggatggacagcaccggagtcctggacaaaatacaggttaccgaggagacgagcctcgtcctgcagaccctcggatacacgtgcacctgtcgaggaataatcaacgtgaaaggaaagggggacctgaagacgtactttgtaaacacagaaatgtcaaggtccctttcccagagcaacgtggcatcctgaagagtcaccttcattttggcaagaagactgtattttcaggaaggtatcacacactttctgactgcaacttctgtcccttgtttttgatgtgcgtgctgtctgtcctatggagcctctgcagactcgttctcgtgacccagtggcataccgtttggtgtctgatgtgtgcccagatcgttctgccacttgcactgtgcttgctcctaagcaaaagggaaaaggagcgcgcgtgatagaagaaaagcactgggagaactaacagaggagaaaggtgaaacacacacacattcttaaggcaataaaactagggggtgtatattatcttctggtgcatgttcttttctggaaaatatggtagctcgccaaccgcatctgctcatctgatattcaaacacacagtattcgtgaataagttgattctgtcccccacgtggactctgtgctcacccattgtctcattgccagtggtgtccaagggcccccgttgggacccacggctctcgtccctctgctccgtgtgtctcatgccagcagcacgtcgccatccgtcaccagaattagtcctcacagcctaggaccagttttgtatcaaactcgtctgatgttttgatgccatttgtcttttgtaaagttaattcattaaaagttttatgtactttga

SEQ ID NO: 319033 - DNA, 1655 bp, Homo sapiens
atccatgtcagaggttgactgaaggacatttcagggacacagagggctttatggggagggtggaagttctgtttgggggttcttttttcggtttcattttgttctttttgttttctctttaaaacctccactctctggcaggacaagatgcctattgtttctttacctctgtgtcctcttgtaacagaatgaatattactgtaggttagacttcttatggaagaacaaattcaaaaaagagcgggaggagatagagaccatggagaacctgaaccgcgtgctgctggagaacgtgcttcccgcgcacgtggctgagcacttcctggccaggagcctgaagaatgaggagctataccaccagtcctatgactgcgtctgcgtcatgtttgcctccattccggatttcaaagaattttatacagaatccgacgtgaacaaggagggcttggaatgccttcggctcctgaacgagatcatcgctgactttgatgatcttctttccaagccaaaattcagtggagttgaaaagattaagaccattggcagcacatacatggcagcaacaggtctgagcgctgtgcccagccaggagcactcccaggagcccgagcggcagtacatgcacattggcaccatggtggagtttgcttttgccctggtagggaagctggatgccatcaacaagcactccttcaacgacttcaaattgcgagtgggtattaaccatggacctgtgatagctggtgtgattggagctcagaagccacaatatgatatctggggcaacactgtcaatgtggccagtaggatggacagcaccggagtcctggacaaaatacaggttaccgaggagacgagcctcgtcctgcagaccctcggatacacgtgcacctgtcgaggaataatcaacgtgaaaggaaagggggacctgaagacgtactttgtaaacacagaaatgtcaaggtccctttcccagagcaacgtggcatcctgaagagtcaccttcattttggcaagaagactgtattttcaggaaggtatcacacactttctgactgcaacttctgtcccttgtttttgatgtgcgtgctgtctgtcctatggagcctctgcagactcgttctcgtgacccagtggcataccgtttggtgtctgatgtgtgcccagatcgttctgccacttgcactgtgcttgctcctaagcaaaagggaaaaggagcgcgcgtgatagaagaaaagcactgggagaactaacagaggagaaaggtgaaacacacacacattcttaaggcaataaaactagggggtgtatattatcttctggtgcatgttcttttctggaaaatatggtagctcgccaaccgcatctgctcatctgatattcaaacacacagtattcgtgaataagttgattctgtcccccacgtggactctgtgctcacccattgtctcattgccagtggtgtccaagggcccccgttgggacccacggctctcgtccctctgctccgtgtgtctcatgccagcagcacgtcgccatccgtcaccagaattagtcctcacagcctaggaccagttttgtatcaaactcgtctgatgttttgatgccatttgtcttttgtaaagttaattcattaaaagttttatgtactttga

SEQ ID NO: 319034 - DNA, 1320 bp, Homo sapiens
ctcttttccggttagcgcggcgtgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgtgacccagtggcataccgtttggtgtctgatgtgtgcccagatcgttctgccacttgcactgtgcccagccaggagcactcccaggagcccgagcggcagtacatgcacattggcaccatggtggagtttgcttttgccctggtagggaagctggatgccatcaacaagcactccttcaacgacttcaaattgcgagtgggtattaaccatggacctgtgatagctggtgtgattggagctcagaagccacaatatgatatctggggcaacactgtcaatgtggccagtaggatggacagcaccggagtcctggacaaaatacaggttaccgaggagacgagcctcgtcctgcagaccctcggatacacgtgcacctgtcgaggaataatcaacgtgaaaggaaagggggacctgaagacgtactttgtaaacacagaaatgtcaaggtccctttcccagagcaacgtggcatcctgaagagtcaccttcattttggcaagaagactgtattttcaggaaggtatcacacactttctgactgcaacttctgtcccttgtttttgatgtgcgtgctgtctgtcctatggagcctctgcagactcgttctcgtgacccagtggcataccgtttggtgtctgatgtgtgcccagatcgttctgccacttgcactgtgcttgctcctaagcaaaagggaaaaggagcgcgcgtgatagaagaaaagcactgggagaactaacagaggagaaaggtgaaacacacacacattcttaaggcaataaaactagggggtgtatattatcttctggtgcatgttcttttctggaaaatatggtagctcgccaaccgcatctgctcatctgatattcaaacacacagtattcgtgaataagttgattctgtcccccacgtggactctgtgctcacccattgtctcattgccagtggtgtccaagggcccccgttgggacccacggctctcgtccctctgctccgtgtgtctcatgccagcagcacgtcgccatccgtcaccagaattagtcctcacagcctaggaccagttttgtatcaaactcgtctgatgttttgatgccatttgtcttttgtaaagttaattcattaaaagttttatgtactttga

SEQ ID NO: 319035 - DNA, 2184 bp, Homo sapiens
ggagcctaccataagcacctcatggaactcgctcttcagcaaacatatcaggacacctgtaattgcatcaagtcgcggatcaagttggaatttgaaaaacgtcaacaggagcggcttctgctctccctgctgccggcccacatcgccatggagatgaaagcggagatcatccagaggctgcagggccccaaggcgggccagatggagaacacaaataacttccacaacctgtatgtgaagcggcatacaaacgtgagcatcttatacgctgacatcgttggctttacccggctggcaagtgactgctccccgggagaactagtccacatgctgaatgagctctttggaaagtttgatcaaattgcaaaggagaatgaatgcatgagaattaaaattttaggagactgctactactgtgtatctggactccctatatctctccctaaccatgccaagaactgtgtgaaaatggggctggacatgtgtgaagccataaagaaagtgagggatgctactggagttgatatcaacatgcgcgtgggcgtgcattctgggaatgtcctgtgtggcgtgattggtctgcagaagtggcaatatgatgtgtggtcacatgatgtgaccttggccaaccacatggaagctggaggggtccctggacgtgttcacatttcttctgtcaccctggagcacttgaatggcgcttataaagtggaggagggagatggtgacattagggacccatatttaaaacagcacctggtgaaaacctactttgtgatcaaccccaagggagaacgacggagcccccagcatctcttcagacctcgccacacccttgatggagccaaaatgagggcctcggtccgcatgacccggtacttggagtcctggggggcagccaagccctttgcacacctacatcacagggacagcatgaccacagagaacggcaagatcagcaccacggatgtacccatgggtcagcataattttcaaaatcgcaccttaagaaccaagtcacaaaagaagagatttgaagaagaattgaatgaaaggatgattcaagcaattgatgggattaatgcacagaagcaatggctcaagtctgaagacattcagagaatctcactgcttttctataacaaagtactagaaaaagagtaccgggccacggcactgccagcgttcaagtattatgtgacttgtgcctgtctcatattcttctgcatcttcattgtgcagattctcgtgctgccaaaaacgtctgtcctgggcatctcctttggggctgcgtttctcttgctggccttcatcctcttcgtctgctttgctggacagcttctgcaatgcagcaaaaaagcctctcccctgctcatgtggcttttgaagtcctcgggcatcattgccaaccgcccctggccacggatctctctcacgatcatcaccacagccatcatattaatgatggccgtgttcaacatgtttttcctgagtgactcagaggaaacaatccctccaactgccaacacaacaaacacaagcttttcagcctcaaataatcaggtggcgattctgcgtgcgcagaatttatttttcctcccgtactttatctacagctgcattctgggactgatatcctgttccgtgttcctgcgggtaaactatgagctgaagatgttgatcatgatggtggccttggtgggctacaacaccatcctactccacacccacgcccacgtcctgggcgactacagccaggtcttatttgagagaccaggcatttggaaagacctgaagaccatgggctctgtgtctctctctatattcttcatcacactgcttgttctgggtagacaggtaagaagtctgtttatatatatgtatgtataccttctctaaagtgctgtattaatagtgctttgctgtgcattgtagttaatcttcttggaaacaaacgtctaagaattagaatcatcttatcactgaagataaaactagttagtacagggtgtggatgcttcgatatagacaaaaggaaaaatatctttcgtattttccacaaaaggcaaatgttatgaatggccaaaattttaatcagttaatttcctgttaaatctcaaaacaaattttgtagtttttgtaagcctacaaaagtgttccttcaataactgacactatttgaaa

SEQ ID NO: 319036 - DNA, 1349 bp, Homo sapiens
tctagcttcctccaagctccccctccacccaccactattcctcaggaagactcaagatctgggagatggaccaggcatttggaaagacctgaagaccatgggctctgtgtctctctctatattcttcatcacactgcttgttctgggtagacagcacatgcacatcattcactgtcaggttcagcacttcattcatggcacagcacaccaacattcatacacacaagcagcgggcaggcagcatcagcagcacccatggccagcacacctgcacaccggcgctgctagctaggcagcaacggtgctatcccagcgacacgtggactgaagccacttccctggccccaggcagccatgcacagcaatgcaggcagctcatacccacccagctcctcatgcacatggcagtccctgcgatccatagtataagcacgtccacatctccaggaatttcccaacagcacatcttctcatcaccagcacataccgcacagatgcaacgaagggcaggcgcctctggcacaatgccctatcggagcatccttagcaacggcagcatcgcaatcgacataggaacctacaaggaatggccatcgttatctatatcacacaaggccacaaccacatcacaagcagggaagattagcacacacaaggcatgcaacagcaacccaatcgaggcccaaggcaaacatcaccaatggggcaaggacccacacaaggggtcgttggcagacggacctggaggcaccaacagaacaacgagaacgccaccttcacaccaagaggcacgaccactgcaggacgagacccagaccacagagtggcgaacacactttagagcgcaacacacatggggcagtggcaagaatcacaggacttatcagggacacgcacgaagatcagcggcgacaacgccatggagcacgtgaccaagatccaacaaacaacaaggcccatcgtccccgtctcaccaaccgggaccgcctatcacccacgttcggcgccaccacaggcggcaggcagtaacatacacagccgcccacagtgggaggaaaccgcacctggcgggacaatagaggacctgggggacggggctgcgacacactagggagaacaaagccactcaaccagcaaagcgacagcccaccgcacgcagacaggcgaacaacaagccagtaggagagcgccagaccaacacacgacggagtaccacaaacagggacggccccacccacgacccaagagcgcacaccggcgcagacactagaaagcccagaggacaaccgcaactcgcaccacgcccacaccagccacagagagaaacgccaagacaagagcataaacga

SEQ ID NO: 319037 - DNA, 3271 bp, Homo sapiens
ggagcctaccataagcacctcatggaactcgctcttcagcaaacatatcaggacacctgtaattgcatcaagtcgcggatcaagttggaatttgaaaaacgtcaacaggagcggcttctgctctccctgctgccggcccacatcgccatggagatgaaagcggagatcatccagaggctgcagggccccaaggcgggccagatggagaacacaaataacttccacaacctgtatgtgaagcggcatacaaacgtgagcatcttatacgctgacatcgttggctttacccggctggcaagtgactgctccccgggagaactagtccacatgctgaatgagctctttggaaagtttgatcaaattgcaaaggagaatgaatgcatgagaattaaaattttaggagactgctactactgtgtatctggactccctatatctctccctaaccatgccaagaactgtgtgaaaatggggctggacatgtgtgaagccataaagaaagtgagggatgctactggagttgatatcaacatgcgcgtgggcgtgcattctgggaatgtcctgtgtggcgtgattggtctgcagaagtggcaatatgatgtgtggtcacatgatgtgaccttggccaaccacatggaagctggaggggtccctggacgtgttcacatttcttctgtcaccctggagcacttgaatggcgcttataaagtggaggagggagatggtgacattagggacccatatttaaaacagcacctggtgaaaacctactttgtgatcaaccccaagggagaacgacggagcccccagcatctcttcagacctcgccacacccttgatggagccaaaatgagggcctcggtccgcatgacccggtacttggagtcctggggggcagccaagccctttgcacacctacatcacagggacagcatgaccacagagaacggcaagatcagcaccacggatgtacccatgggtcagcataattttcaaaatcgcaccttaagaaccaagtcacaaaagaagagatttgaagaagaattgaatgaaaggatgattcaagcaattgatgggattaatgcacagaagcaatggctcaagtctgaagacattcagagaatctcactgcttttctataacaaagtactagaaaaagagtaccgggccacggcactgccagcgttcaagtattatgtgacttgtgcctgtctcatattcttctgcatcttcattgtgcagattctcgtgctgccaaaaacgtctgtcctgggcatctcctttggggctgcgtttctcttgctggccttcatcctcttcgtctgctttgctggacagcttctgcaatgcagcaaaaaagcctctcccctgctcatgtggcttttgaagtcctcgggcatcattgccaaccgcccctggccacggatctctctcacgatcatcaccacagccatcatattaatgatggccgtgttcaacatgtttttcctgagtgactcagaggaaacaatccctccaactgccaacacaacaaacacaagcttttcagcctcaaataatcaggtggcgattctgcgtgcgcagaatttatttttcctcccgtactttatctacagctgcattctgggactgatatcctgttccgtgttcctgcgggtaaactatgagctgaagatgttgatcatgatggtggccttggtgggctacaacaccatcctactccacacccacgcccacgtcctgggcgactacagccaggtcttatttgagagaccaggcatttggaaagacctgaagaccatgggctctgtgtctctctctatattcttcatcacactgcttgttctgggtagacagaatgaatattactgtaggttagacttcttatggaagaacaaattcaaaaaagagcgggaggagatagagaccatggagaacctgaaccgcgtgctgctggagaacgtgcttcccgcgcacgtggctgagcacttcctggccaggagcctgaagaatgaggagctataccaccagtcctatgactgcgtctgcgtcatgtttgcctccattccggatttcaaagaattttatacagaatccgacgtgaacaaggagggcttggaatgccttcggctcctgaacgagatcatcgctgactttgatgatcttctttccaagccaaaattcagtggagctgtgcccagccaggagcactcccaggagcccgagcggcagtacatgcacattggcaccatggtggagtttgcttttgccctggtagggaagctggatgccatcaacaagcactccttcaacgacttcaaattgcgagtgggtattaaccatggacctgtgatagctggtgtgattggagctcagaagccacaatatgatatctggggcaacactgtcaatgtggccagtaggatggacagcaccggagtcctggacaaaatacaggttaccgaggagacgagcctcgtcctgcagaccctcggatacacgtgcacctgtcgaggaataatcaacgtgaaaggaaagggggacctgaagacgtactttgtaaacacagaaatgtcaaggtccctttcccagagcaacgtggcatcctgaagagtcaccttcattttggcaagaagactgtattttcaggaaggtatcacacactttctgactgcaacttctgtcccttgtttttgatgtgcgtgctgtctgtcctatggagcctctgcagactcgttctcgtgacccagtggcataccgtttggtgtctgatgtgtgcccagatcgttctgccacttgcactgtgcttgctcctaagcaaaagggaaaaggagcgcgcgtgatagaagaaaagcactgggagaactaacagaggagaaaggtgaaacacacacacattcttaaggcaataaaactagggggtgtatattatcttctggtgcatgttcttttctggaaaatatggtagctcgccaaccgcatctgctcatctgatattcaaacacacagtattcgtgaataagttgattctgtcccccacgtggactctgtgctcacccattgtctcattgccagtggtgtccaagggcccccgttgggacccacggctctcgtccctctgctccgtgtgtctcatgccagcagcacgtcgccatccgtcaccagaattagtcctcacagcctaggaccagttttgtatcaaactcgtctgatgttttgatgccatttgtcttttgtaaagttaattcattaaaagttttatgtactttga

SEQ ID NO: 319038 - DNA, 5874 bp, Homo sapiens
  misc_feature (4647)..(4647): n is a, c, g, or t
  misc_feature (4845)..(4845): n is a, c, g, or t
  misc_feature (5493)..(5493): n is a, c, g, or t
  misc_feature (5621)..(5621): n is a, c, g, or t
ggagcctaccataagcacctcatggaactcgctcttcagcaaacatatcaggacacctgtaattgcatcaagtcgcggatcaagttggaatttgaaaaacgtcaacaggagcggcttctgctctccctgctgccggcccacatcgccatggagatgaaagcggagatcatccagaggctgcagggccccaaggcgggccagatggagaacacaaataacttccacaacctgtatgtgaagcggcatacaaacgtgagcatcttatacgctgacatcgttggctttacccggctggcaagtgactgctccccgggagaactagtccacatgctgaatgagctctttggaaagtttgatcaaattgcaaaggagaatgaatgcatgagaattaaaattttaggagactgctactactgtgtatctggactccctatatctctccctaaccatgccaagaactgtgtgaaaatggggctggacatgtgtgaagccataaagaaagtgagggatgctactggagttgatatcaacatgcgcgtgggcgtgcattctgggaatgtcctgtgtggcgtgattggtctgcagaagtggcaatatgatgtgtggtcacatgatgtgaccttggccaaccacatggaagctggaggggtccctggacgtgttcacatttcttctgtcaccctggagcacttgaatggcgcttataaagtggaggagggagatggtgacattagggacccatatttaaaacagcacctggtgaaaacctactttgtgatcaaccccaagggagaacgacggagcccccagcatctcttcagacctcgccacacccttgatggagccaaaatgagggcctcggtccgcatgacccggtacttggagtcctggggggcagccaagccctttgcacacctacatcacagggacagcatgaccacagagaacggcaagatcagcaccacggatgtacccatgggtcagcataattttcaaaatcgcaccttaagaaccaagtcacaaaagaagagatttgaagaagaattgaatgaaaggatgattcaagcaattgatgggattaatgcacagaagcaatggctcaagtctgaagacattcagagaatctcactgcttttctataacaaagtactagaaaaagagtaccgggccacggcactgccagcgttcaagtattatgtgacttgtgcctgtctcatattcttctgcatcttcattgtgcagattctcgtgctgccaaaaacgtctgtcctgggcatctcctttggggctgcgtttctcttgctggccttcatcctcttcgtctgctttgctggacagcttctgcaatgcagcaaaaaagcctctcccctgctcatgtggcttttgaagtcctcgggcatcattgccaaccgcccctggccacggatctctctcacgatcatcaccacagccatcatattaatgatggccgtgttcaacatgtttttcctgagtgactcagaggaaacaatccctccaactgccaacacaacaaacacaagcttttcagcctcaaataatcaggtggcgattctgcgtgcgcagaatttatttttcctcccgtactttatctacagctgcattctgggactgatatcctgttccgtgttcctgcgggtaaactatgagctgaagatgttgatcatgatggtggccttggtgggctacaacaccatcctactccacacccacgcccacgtcctgggcgactacagccaggtcttatttgagagaccaggcatttggaaagacctgaagaccatgggctctgtgtctctctctatattcttcatcacactgcttgttctgggtagacagaatgaatattactgtaggttagacttcttatggaagaacaaattcaaaaaagagcgggaggagatagagaccatggagaacctgaaccgcgtgctgctggagaacgtgcttcccgcgcacgtggctgagcacttcctggccaggagcctgaagaatgaggagctataccaccagtcctatgactgcgtctgcgtcatgtttgcctccattccggatttcaaagaattttatacagaatccgacgtgaacaaggagggcttggaatgccttcggctcctgaacgagatcatcgctgactttgatgatcttctttccaagccaaaattcagtggagttgaaaagattaagaccattggcagcacatacatggcagcaacaggtctgagcgctgtgcccagccaggagcactcccaggagcccgagcggcagtacatgcacattggcaccatggtggagtttgcttttgccctggtagggaagctggatgccatcaacaagcactccttcaacgacttcaaattgcgagtgggtattaaccatggacctgtgatagctggtgtgattggagctcagaagccacaatatgatatctggggcaacactgtcaatgtggccagtaggatggacagcaccggagtcctggacaaaatacaggttaccgaggagacgagcctcgtcctgcagaccctcggatacacgtgcacctgtcgaggaataatcaacgtgaaaggaaagggggacctgaagacgtactttgtaaacacagaaatgtcaaggtccctttcccagagcaacgtggcatcctgaagagtcaccttcattttggcaagaagactgtattttcaggaaggtatcacacactttctgactgcaacttctgtcccttgtttttgatgtgcgtgctgtctgtcctatggagcctctgcagactcgttctcgtgacccagtggcataccgtttggtgtctgatgtgtgcccagatcgttctgccacttgcactgtgcttgctcctaagcaaaagggaaaaggagcgcgcgtgatagaagaaaagcactgggagaactaacagaggagaaaggtgaaacacacacacattcttaaggcaataaaactagggggtgtatattatcttctggtgcatgttcttttctggaaaatggggctggacatgtgtgaagccataaagaaagtgagggatgctactggagttgatatcaacatgcgcgtgggcgtgcattctgggaatgtcctgtgtggcgtgattggtctgcagtggtgtccaagggcccccgttgggacccacggctctcgtccctctgctccgtgtgtctcatgccagcagcacgtcgccatccgtcaccagaattagtcctcacagcctaggaccagttttgtatcaaactcgtctgatgttttgatgccatttgtcttttgtaaagttaattcattaaaagttttatgtactttgatttacagtgcctgtatcttttattttcctgtcttctttctcctgtggtttgctccagaattaaggtttgttttccatccattctcccttttgacacagttgtttcagaaagagctctccagaagccaatattgagatgtaattcagattaggacacagtgtgtgacgcagataactggttactcagctccctggaaagcaggcaagcatgttgaatgtatctagtggtctgattttaatttgggcatctctagagaacgctttcagggaaaaatactttaatagtaaaaagattctctgcgagcaacagtgccccctccgtccactacgctcctgtctccaagaatgttttgctagagctaacagacatagactgcaaaagaataatttggaatcagctatgcaaatcagtctcacaatagcgtgagctaactgagagaagtactaagacccacaaactgcctgttaagtctgagaaggctaaagaagacacacagccaacgttcatgcatttttaaagacagaaggccttgaagaatttgttcttgtaaatccaacacaagttgtttggtacttttaacataaagaaatcatactttgccaaatagtgaaaagtagagcaatcgtgtataagctaatgtttaaaagcaaaactgcaaattgtagcccagttggtcaaacttgttttctttttataactcatggcaggcatctgtaagaagtagagaacccagatgatctcttaggaagccttttattcgtgggaactcgaacttgaagcacaagttcctggtttgaatcctggctctgattttttactggctgtgtgactttgaacacatctcttagtccctcttaggagtactttccttattggcaacttatggactcgctagtgattaaacgaggcaatgactgtgagcgagcctggcaggtgccccgtggtacattcacagcacgggcacagctgctgtgccaggactgtgactcattcccagtaaaaggcacttatcgaagctgataaccgtccttcatcaccgaagtgtgagtagagcatgacttatttagtattctgcctcaatggggaattttttgatcctgtaatcacaactcagcattggccttaatatacctaaatctccaaaaacagtgattaaagcaagagaattattacaagggcttttctctttcctctaactcattcttcacggatgccgtagcgtttccgtgagctcaaactggccttggtgtaaaatgtgtaaggatgagcagcaggcgtgcctcgtgggttcttcctctgttacatcctgctacactcatcngcaggtcaccttagttcacctaccctgagtgaacacccccagctgggtggtccaccaagttctcataaacagagtccctcccattcccccacggggtgcaccgaacttgggtttgcgctaaaaagaactcaaaaggagaactgtgctctcccaaagccatatcaccagtcttaccaaacaataggcttttaaaagcantgagtcattgtcagaatccactatgggaagctctgtgtgtacctggtcccttctaggtgtggtcccataggagcagccttagcatcccctgtgaacttatcaaaaatgcaaattctcaggccccaacctgaaggaggaccctgaatttgagatccccggggctggggcccagcacaactgctgtttagtgaacaggttctccaggtgattctgatccctgatcaagcttcagacctccctccctccccagtgtttttgcaggtgaggaaacaggggcagagtaattcaggcacatgtgttcagagttccacagttgattagcagttgaggccaggctagaatggaaaactgcctgttccttgaatctgaaagagcattattcctggtcaaagctccttaaagttctgggcagctaaaagcatccctgtgagcaaaaatgccaggcagaaaactggcagtgcacctctcatcagcccaggtcccagtgccattggcttcaagaaaaaaaaaaatctctccccaatgctctccttaacctttaagtcttacaggaagcctctcatagaaattgcctccagtccagtttcccaaaaaccccagtgttttacatatctgtttaggagtgtctaagttttgtcatcaatccangatgttattcttccttcccaactcactgtgctcctaaaggcagcaaccattcatctttcctttgctctggatacaccgaatgaccaggtaacatcatcaggccgggtgcagtggctcctataatcccnatattttgggaggccgaggagagaggatcacttaagcccaggagtctgagaccagcctgggcaacatagcaagacccccatctctgcaaaaaaataagaaaattagcttggcatggtggcacgtgcctgtagtcccagctacatgggaggctgaggtgggaggatcacttgagcccaggaagtccagaacgtagtgagccttgattataccactgcactccagcctgggtgacagagcgagactctgtctcag

SEQ ID NO: 319039 - DNA, 649 bp, Homo sapiens
  misc_feature (25)..(25): n is a, c, g, or t
actagttctagatcgcgagcggccncctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319040 - DNA, 598 bp, Homo sapiens
tttattaaaaatccaaagataagtcttctaatttaattgggtacaaaatatacctaaagacttatctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319041 - DNA, 392 bp, Homo sapiens
  misc_feature (25)..(25): n is a, c, g, or t
actagttctagatcgcgagcggccntttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319042 - DNA, 2646 bp, Homo sapiens
  misc_feature (24)..(24): n is a, c, g, or t
taaggctaggtcgggctgggtgtnaatcggccgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319043 - DNA, 2585 bp, Homo sapiens
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgattatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319044 - DNA, 4226 bp, Homo sapiens
  misc_feature (1402)..(1402): n is a, c, g, or t
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaagtatgaagacatcactgcctttttctcagttggttgttaggttgagaacattaaaaatcttgtggccaaagattttgggcaacaagtacctactaagtaaagatataatgttagagataccatatgagtcacatccaccacacttaaaagtattcaaaaataagtcatcttgaaatgtagttcagaaggaactgggagaacatgttcatcatagaaccaacaattttaaaacataaactacctgagaagtcatgtaggtccaaccatattatttctcaggtgagaaaacaggctaataacttccatgattaaacacattactagtgggagaactccagagttcttttctgactcccattggtgctccttctacnaggcaaggaatctttatattaggtttattctagcatgaccccttttaaggtttaaactggtgataaatatattatttgctcatgtcattcttcagtgctttgaagattttatagagaagaactcaggctcttttactgcattgagtcttaaaaggggggttgaattccgaagggatcaaataaatccaacgtagtagttgcatcagaaaccatattaggaaaaccctccttaaacggcaaaaggcagagatcagttccttgagtataaagtgttagggatggaagaatgaaactaaatgaacccattatctactcctaagtaattaagtgatgtgcacagatacacctagctataggtaaacaggaaaattggttgtgcaaaaaacaagtgaggtttttcttgactataagttttcccttttggaaaaattcgctgtggatttgagtatattttctcttagacattaaattgagactgagaatttaaaactttttgtagcaatgtattgataatagaaagcattaaagctgttttgctaagtagtgttgttgattcagaagtgatttggactatccattcatgacacgtaaatattttgttttggactccttccaattgtttcattagataattgaaacaaccttttggattttttagctttgcattttaaaaatgtcttaatggtttatttaactaaaggtggatttctggcactaatttatctttatttttcttggcttcttcaaggacagtaatagagtgtgaatgtttggattttactgtccatgactttatggtttgatcatttatagccagctcagccttgcatacagatttaagacagtttatgaacctaaactttttttcccccaccatcattggctttcttcattcttgagtattgttaaattaatggaatagttatttttccatgatgaaaaattcttataaaaatggtctaaatggaaaagacatgcatttatacactttttttgtagtctctttctttggtttctgagctctgtacttttgaggacattagtcttactcattgaactgaaatgcgtagcctcaaaggaacaccatagaaaagagccatcattattgtcagtgaacagtcagtacttacattgctgaaatataaattacaagtggttccttttggttaaaattatcttttttttttcttcaaaattcctttttagatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319045 - DNA, 1680 bp, Homo sapiens
  misc_feature (1524)..(1524): n is a, c, g, or t
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaaaaaaattgtgtgtggggcgcgcccgtgggcccctggaaaaagtttttaaaaccttcggttgggggcggcgggggccccaggggttagggtaaccgtgggccaaagggtgttcccaaagggagaactcgggcgccaactgagacgataaggggccgggggttctcttccaccaacttanaaaacacgcgccggggcgggcacaccgagagccggtccgtggaacaatcccaagaagggagaggtccgggagggccatcaccgggggatctcctatcaaacgagggggtcctacgcgaagacgcccggatactaaattaaccgccggggtcggggt

SEQ ID NO: 319046 - DNA, 2815 bp, Homo sapiens
ggctttgtacctggggcagcgcagtgggacggaaattgggagtggagggcggtggcctagatcctcacctcttcgtattgtttcacgcggcagtgcttgggagtcagtgtagctccagtcagtgttatcagcaccttcgcactggcgctttgccagggaagagagttatctatggcttgaatacctcggtgccgtcctctcgtttctctgggaaactgcagtacggagatgctatctccagtaatgagaaggcctttggtgtctcttcggggcttctgggactgcagtagagagagagaaggatttgaaatttccctgcccaagaatcaacaggaactctgtttatagaccagaaatgtgacatctatctttggtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319047 - DNA, 2757 bp, Homo sapiens
ggctttgtacctggggcagcgcagtgggacggaaattgggagtggagggcggtggcctagatcctcacctcttcgtattgtttcacgcggcagtgcttgggagtcagtgtagctccagtcagtgttatcagcaccttcgcactggcgctttgccagggaagagagttatctatggcttgaatacctcggtgccgtcctctcgtttctctgggaaactgcagtacggagatgctatctccaaaggatttgaaatttccctgcccaagaatcaacaggaactctgtttatagaccagaaatgtgacatctatctttggtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319048 - DNA, 2523 bp, Homo sapiens
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacagcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319049 - DNA, 2712 bp, Homo sapiens
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacgctgggcgtggtggctcacgcctgtaatcccagcactttgggaggccgaggcgggcggatcacaacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319050 - DNA, 2535 bp, Homo sapiens
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319051 - DNA, 3584 bp, Homo sapiens
  misc_feature (760)..(760): n is a, c, g, or t
tatctctaacataacctatgtgtagggaaaagcacacacatgtttactgcccattataaaaaattcaggatccttaaattcagggctcctctcctatacgcaacccactacatgtacatgtgtcccctttctgcattgccataggaactgtggctcgggaaaccagtgcaaatgccaatacccttgttactattattgcagtgaataacgagctgtcctttgtctctagcccagtggtctcatgtctaatgttagagatacgtatctctaacattggtggattacaggaggtggcagaacagttagagctggaacggataggaccacaacatcaggcaggatctgattcattgctcacaggaatggcctttttcaaaatgagagaagtatgaagacatcactgcctttttctcagttggttgttaggttgagaacattaaaaatcttgtggccaaagattttgggcaacaagtacctactaagtaaagatataatgttagagataccatatgagtcacatccaccacacttaaaagtattcaaaaataagtcatcttgaaatgtagttcagaaggaactgggagaacatgttcatcatagaaccaacaattttaaaacataaactacctgagaagtcatgtaggtccaaccatattatttctcaggtgagaaaacaggctaataacttccatgattaaacacattactagtgggagaactccagagttcttttctgactcccattggtgctccttctacnaggcaaggaatctttatattaggtttattctagcatgaccccttttaaggtttaaactggtgataaatatattatttgctcatgtcattcttcagtgctttgaagattttatagagaagaactcaggctcttttactgcattgagtcttaaaaggggggttgaattccgaagggatcaaataaatccaacgtagtagttgcatcagaaaccatattaggaaaaccctccttaaacggcaaaaggcagagatcagttccttgagtataaagtgttagggatggaagaatgaaactaaatgaacccattatctactcctaagtaattaagtgatgtgcacagatacacctagctataggtaaacaggaaaattggttgtgcaaaaaacaagtgaggtttttcttgactataagttttcccttttggaaaaattcgctgtggatttgagtatattttctcttagacattaaattgagactgagaatttaaaactttttgtagcaatgtattgataatagaaagcattaaagctgttttgctaagtagtgttgttgattcagaagtgatttggactatccattcatgacacgtaaatattttgttttggactccttccaattgtttcattagataattgaaacaaccttttggattttttagctttgcattttaaaaatgtcttaatggtttatttaactaaaggtggatttctggcactaatttatctttatttttcttggcttcttcaaggacagtaatagagtgtgaatgtttggattttactgtccatgactttatggtttgatcatttatagccagctcagccttgcatacagatttaagacagtttatgaacctaaactttttttcccccaccatcattggctttcttcattcttgagtattgttaaattaatggaatagttatttttccatgatgaaaaattcttataaaaatggtctaaatggaaaagacatgcatttatacactttttttgtagtctctttctttggtttctgagctctgtacttttgaggacattagtcttactcattgaactgaaatgcgtagcctcaaaggaacaccatagaaaagagccatcattattgtcagtgaacagtcagtacttacattgctgaaatataaattacaagtggttccttttggttaaaattatcttttttttttcttcaaaattcctttttagatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319052 - DNA, 3343 bp, Homo sapiens
  misc_feature (519)..(519): n is a, c, g, or t
tcttcttgacaagcaattttttattttttctaggggtggattacaggaggtggcagaacagttagagctggaacggataggaccacaacatcaggcaggatctgattcattgctcacaggaatggcctttttcaaaatgagagaagtatgaagacatcactgcctttttctcagttggttgttaggttgagaacattaaaaatcttgtggccaaagattttgggcaacaagtacctactaagtaaagatataatgttagagataccatatgagtcacatccaccacacttaaaagtattcaaaaataagtcatcttgaaatgtagttcagaaggaactgggagaacatgttcatcatagaaccaacaattttaaaacataaactacctgagaagtcatgtaggtccaaccatattatttctcaggtgagaaaacaggctaataacttccatgattaaacacattactagtgggagaactccagagttcttttctgactcccattggtgctccttctacnaggcaaggaatctttatattaggtttattctagcatgaccccttttaaggtttaaactggtgataaatatattatttgctcatgtcattcttcagtgctttgaagattttatagagaagaactcaggctcttttactgcattgagtcttaaaaggggggttgaattccgaagggatcaaataaatccaacgtagtagttgcatcagaaaccatattaggaaaaccctccttaaacggcaaaaggcagagatcagttccttgagtataaagtgttagggatggaagaatgaaactaaatgaacccattatctactcctaagtaattaagtgatgtgcacagatacacctagctataggtaaacaggaaaattggttgtgcaaaaaacaagtgaggtttttcttgactataagttttcccttttggaaaaattcgctgtggatttgagtatattttctcttagacattaaattgagactgagaatttaaaactttttgtagcaatgtattgataatagaaagcattaaagctgttttgctaagtagtgttgttgattcagaagtgatttggactatccattcatgacacgtaaatattttgttttggactccttccaattgtttcattagataattgaaacaaccttttggattttttagctttgcattttaaaaatgtcttaatggtttatttaactaaaggtggatttctggcactaatttatctttatttttcttggcttcttcaaggacagtaatagagtgtgaatgtttggattttactgtccatgactttatggtttgatcatttatagccagctcagccttgcatacagatttaagacagtttatgaacctaaactttttttcccccaccatcattggctttcttcattcttgagtattgttaaattaatggaatagttatttttccatgatgaaaaattcttataaaaatggtctaaatggaaaagacatgcatttatacactttttttgtagtctctttctttggtttctgagctctgtacttttgaggacattagtcttactcattgaactgaaatgcgtagcctcaaaggaacaccatagaaaagagccatcattattgtcagtgaacagtcagtacttacattgctgaaatataaattacaagtggttccttttggttaaaattatcttttttttttcttcaaaattcctttttagatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319053 - DNA, 1945 bp, Homo sapiens
  misc_feature (1402)..(1402): n is a, c, g, or t
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaagtatgaagacatcactgcctttttctcagttggttgttaggttgagaacattaaaaatcttgtggccaaagattttgggcaacaagtacctactaagtaaagatataatgttagagataccatatgagtcacatccaccacacttaaaagtattcaaaaataagtcatcttgaaatgtagttcagaaggaactgggagaacatgttcatcatagaaccaacaattttaaaacataaactacctgagaagtcatgtaggtccaaccatattatttctcaggtgagaaaacaggctaataacttccatgattaaacacattactagtgggagaactccagagttcttttctgactcccattggtgctccttctacnaggcaaggaatctttatattaggtttattctagcatgaccccttttaaggtttaaactggtgataaatatattatttgctcatgtcattcttcagtgctttgaagattttatagagaagaactcaggctcttttactgcattgagtcttaaaaggggggttgaattccgaagggatcaaataaatccaacgtagtagttgcatcagaaaccatattaggaaaaccctccttaaacggcaaaaggcagagatcagttccttgagtataaagtgttagggatggaagaatgaaactaaatgaacccattatctactcctaagtaattaagtgatgtgcacagatacacctagctataggtaaacaggaaaattggttgtgcaaaaaacaagtgaggtttttcttgactataagttttcccttttggaaaaattcgctgtggatttgagtatattttctcttagacattaaattgagactgagaatttaaaactttttgtagcaatgtattgataatagaaagcattaaagctgttttgctaagta

SEQ ID NO: 319054 - DNA, 1269 bp, Homo sapiens
  misc_feature (1144)..(1144): n is a, c, g, or t
  misc_feature (1147)..(1147): n is a, c, g, or t
  misc_feature (1153)..(1153): n is a, c, g, or t
  misc_feature (1159)..(1159): n is a, c, g, or t
  misc_feature (1166)..(1166): n is a, c, g, or t
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcgcgagagggttctcacantcnagacangaaatngtcgtgncagtgctatgtcgggatgacatcacaggtcgagtattgaggattatctctgctttataaatcggacatagactatacttttctgcctccaggtacctaccagt

SEQ ID NO: 319055 - DNA, 2321 bp, Homo sapiens
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacacgtaagtgggaaataactgtataacccagactttttttttttttctttaatcttaggaattgattttcctcaagtatggtgacatgctaggtgaatttggtgtagttatcctggaaatatataaaacgtaacatttcaaaagcatggttttcttttttactatgggaccaaaaaaaatactttgatgttaaagatgttatatttaaaatatgactgcagctttttttgtatttggaagactgggtattgaaagtacttctgatagaaaaaataatcctacattagttttactttcaaaaattttgtgtgcaatttgaaatatagccttttataatatttatccttcttgtgaagatttttgttgcattcatattccagtttatgagtagattacatgtcaaatgcagtaagacgttttctggaaccttgggtacgttttcctttcaagtcagtattatcattaggttgccacttcagcccacaaaagctctcttaatttacatataggagaagtagtagtatccttgaacctggtgtttatcatatgtcagaatcttcattctaactcaagccctgggtcttcacccagtttccttagttataatatttctgtattattaatagaagtagtcttgatagctaagggaagttttagatgtttttagagaggggcagattatttgcaaactaagttgggtaaataaaataatacattcttattacagcaggacctcaaatgacattttcttcaacattgtttcatggtaaccttcataaaaaataaaattgattcctgacccgggccactacctgagtggagtgtgcacgttctcgtgtatatgtggattttctcccgggtcctctgatttcctcccacatcccaaggctgtgcacgttaggtgaaatggtgtggctaagttgtcccagtgtgagtgagtaggtgtatctgtgtgagtgcactgtgccacggaacgacatgctgaccagggttggttcccacattgtgccctgagctgccagaataggctctggctttcttcacccctcaactgaataatggagcaaataattatcttgtttttattaattgttcttaaatttacatatagctcacatttatttcattgtttaatattagaagtattttggtctttatctagaagtttgatgatttttttgtgaccagaaatatgccgtaggaacttaactcttgtttttatcaattagcctgtggtaaaaattggtttcgttatccatcttttggcttaaagttgcaatttccaagaacttattgataacgttgagtgagtacttaactgtatgttgcaatattgcattgttcttctgtttgacatcctacatttgtgtcatacatcctaatatctggtaggtaaaatagtgaaagaaactgtaggcaattaatggtagtgccaatgtatgaattctttcttcctgttctttgtcagataaacaaagatatttagtatacacaattttacgaaagtagggcttaggaaaagcagagtaatgatgcctgtggtatagtagtgtggcttgtaattacactgtgtttagcctgactctccatttcactcttttgggtttaataatatactctccatttggagaccaaggcaggaggattgcttgaggccaggagttctagaccagcctggtcaacatagactctgtctctacaaaaaaaaaaaa

SEQ ID NO: 319056 - DNA, 2646 bp, Homo sapiens
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319057 - DNA, 2586 bp, Homo sapiens
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatacatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319058 - DNA, 1601 bp, Homo sapiens
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaggcaaaaaaaaaacaaacgcagcacaacacaagagacagagaccgcaaaacaaagagagcaagggagcccaaactacacacaagagggcccggaaaacacccccgaggacgcagaaaacgccaactaacaaaagagacaccgaaggtaacagaaccagcgacccgcaaacccgcgggggcgaaaaggcagtgaaacaaccgtcgggatagacacaaagagaagcagaataccaagtaggaagcgagtgaagcgagtagag

SEQ ID NO: 319059 - DNA, 2541 bp, Homo sapiens
agaaagggggcggggacgatgaacctgagagggtgcgcgatggcgccagctggagtgcggctggcggaggaaggagcctggcggcgggttgggggctgggtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319060 - DNA, 2616 bp, Homo sapiens
agaaagggggcggggacgatgaacctgagagggtgcgcgatggcgccagctggagtgcggctggcggaggaaggagcctggcggcgggttgggggctggaaggatttgaaatttccctgcccaagaatcaacaggaactctgtttatagaccagaaatgtgacatctatctttggtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319061 - DNA, 2827 bp, Homo sapiens
  misc_feature (24)..(24): n is a, c, g, or t
taaggctaggtcgggctgggtgtnaatcggccgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatgggttttggtgttgagaaaaaccttgtgtcagagaagcaattggaaagtacagggcgttttcccctcttttgaaccagttcttcaagaaacttggttttagcattggaatactgtgagcatcatttcatgtatcctttgggagacaggaatttatgattttcccccctttcttggttatagagacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319062 - DNA, 2806 bp, Homo sapiens
ggctttgtacctggggcagcgcagtgggacggaaattgggagtggagggcggtggcctagatcctcacctcttcgtattgtttcacgcggcagtgcttgggagtcagtgtagctccagtcagtgttatcagcaccttcgcactggcgctttgccagggaagagagttatctatggcttgaatacctcggtgccgtcctctcgtttctctgggaaactgcagtacggagatgctatctccagtaatgagaaggcctttggtgtctcttcggggcttctgggactgcagtagagagagaggtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacgctgggcgtggtggctcacgcctgtaatcccagcactttgggaggccgaggcgggcggatcacaacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319063 - DNA, 1814 bp, Homo sapiens
attacaggaggtggcagaacagttagagatttttgcagctcttcatgaggtacttcacatcataaatgacaggaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacagtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataa

SEQ ID NO: 319064 - DNA, 1039 bp, Homo sapiens
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaagtaaggcttcggatggcattatctacagcagcacactgttcagaccaagtgactgtcatgagagcctaggctgggatgttgttttaaaccatattttaaagtattacagtgaatgcaattat

SEQ ID NO: 319065 - DNA, 1329 bp, Homo sapiens
  misc_feature (1329)..(1329): n is a, c, g, or t
ggccagccctcggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaatttctgctcaagtagtatcagtgatcatttaaaatttggaggggtctttggtttacagccatgtgacaattaaaagcactaaagggagatcatgttaaagctcttaatttatattaaaacagtagcctttgtctttaaaaaagttgttgctcatgaatattataaaatgatctacaggtttcaattcaacctgtttctaggtttttttgtaaatttagttttgattaagcattataagcatttgagtctataaactttatagtagcatctttcagaataaacatttttaattgatttcagtggcaactctcaaattgattacaatatgagatatatcagtgtcgtccattaacactcataagaataatatttactgtgtcagtgctattttaggattatagttattgtttgattatttcaggttgaaaagtagaagttccaaggttttgattttggtctggtctttaagtgaaaaattaaagcaaccagtagatgtaggttaaacttttacttcatagacttaatatgtaattaatatattgccaagcaacactgttaaagaaaagtaaaactcattttttcttgttcttaatttatatattacaagatactgtaaggtattctttatgaagttgatatataaaaatttacatttttagaacattagtgaatggatcatcttttacaattaaaagtatattttgattatcagtttcttagn

SEQ ID NO: 319066 - DNA, 424 bp, Homo sapiens
  misc_feature (5)..(5): n is a, c, g, or t
  misc_feature (55)..(55): n is a, c, g, or t
gaagntgactccggaaggctgtgtgaaatgacgcctagtcatcccttgattatcngaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgag

SEQ ID NO: 319067 - DNA, 772 bp, Homo sapiens
tgggctgcaggaattcggcacgaggggagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaaaaaaaaaaaaaaaaaaaaataataataaaaaaaccttttttactttttgacctaatcacttttaaatttagcaactttatccatcccgcccaaatttaaactcaattccccatattcccctaatacgaggtcgtttacaatcaattggtcgtcgtttaagtttggactggaccctggtttaccactttgcc

SEQ ID NO: 319068 - DNA, 500 bp, Homo sapiens
cctcaaaatacatgcacaccaggtaggattattgttaatgaaaagtataatttcagtgtctttacaacttagtttgtgtctaaaatatgaactagtgtttttttccacttgttaaattgatcttgtatttggttttgcgaattttcaaacaaagaataaagaacatgaaattagactatatattctgtcattttcccctgagttttttctaatcttgtcccttcatacttttccccaaaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgag

SEQ ID NO: 319069 - DNA, 504 bp, Homo sapiens
aaacttttgtcaatctgttttttctttttaaatccactattttgagatattattgacatacaataaagtacacctatttttaagtgtacagttctgtgggttttaattaacatggaacctggtctcctaaacagaggagtagaatgttttcattgcctcacaaagttcccttggtcccttttcagtcagtcaccccaccccagccccaggcaatcactggtttgttttctataactttaggttagttttgactcttctggattcttatgtaagcagaatcattgaatgtatctcttttttgagagtcttttaaaatgtttgtttttgtttgctttcagatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgag

SEQ ID NO: 319070 - DNA, 744 bp, Homo sapiens
aaagtgcaacgttctgtggggtggcgctggcgaccctttccttgacgggtaacctctgggagcccagagctctcagactcctcatctcccccagcccccgcccttgtaactgcctagtaaacagcccacaactataggtcgcatttgtgtaacgcagctttgctctacaaacttttttgagagcttgtagtgtgctagatgttagaggggaaaaaatcagacagttgctattccctgtttgccagtattgttagtatatctcctccctccttctcctccccaccactttctctttctttttaacttagaagttgtggtatttgagaagaacactgagtcaccattgccacagactctgatatcggtactgctggtaggccatccatccaaatctagaaagtttctattggtaaatactgctaatcgttatctaaaaagttttttaggcactctcaaatgtaactagtagttaggttttcgtagatttgcctttctcggctccttcctttattagaaacagcaagtactaatcttgatattttacagaaggaaattgggaaaaatgacaataacagaatccagaagtcagaattcaccttttctttgtgcgttgaaaccttgttactttacaataaagcagtccagaaggaggagaatgttcatatagggaagtaatagaagatacatttggaaagcaacaatcacacatctctgctgaaggtccccaacttctggtggttcaac

SEQ ID NO: 319071 - DNA, 270 bp, Homo sapiens
ggaccgcataactattacagcataaactattacagcataaactattacagcataaactattacagcataaactattacagcatgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacctttccgaagaagatcatgactttcaaaagg

SEQ ID NO: 319072 - DNA, 1265 bp, Homo sapiens
ggccagccctcggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaatttctgctcaagtagtatcagtgatcatttaaaatttggaggggtctttggtttacagccatgtgacaattaaaagcactaaagggagatcatgttaaagctcttaatttatattaaaacagtagcctttgtctttaaaaaagttgttgctcatgaatattataaaatgatctacaggtttcaattcaacctgtttctaggtttttttgtaaatttagttttgattaagcattataagcatttgagtctataaactttatagtagcatctttcagaataaacatttttaattgatttcagtggcaactctcaaattgattacaatatgagatatatcagtgtcgtccattaacactcataagaataatatttactgtgtcagtgctattttaggattatagttattgtttgattatttcaggttgaaaagtagaagttccaaggttttgattttggtctggtctttaagtgaaaaattaaagcaaccagtagatgtaggttaaacttttacttcatagacttaatatgtaattaatatattgccaagcaacactgttaaagaaaagtaaaactcattttttcttgttcttaatttatatattacaagatactgtaaggtattctttatgaagttgatatataaaaatttacattttt

SEQ ID NO: 319073 - DNA, 942 bp, Homo sapiens
ggccagccctcggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaatttctgctcaagtagtatcagtgatcatttaaaatttggaggggtctttggtttacagccatgtgacaattaaaagcactaaagggagatcatgttaaagctcttaatttatattaaaacagtagcctttgtctttaaaaaagttgttgctcatgaatattataaaatgatctacaggtttcaattcaacctgtttctaggtttttttgtaaatttagttttgattaagcattataagcatttgagtctataaactttatagtagcatctttcagaataaacatttttggcacaaaaaaaaaaagggggggggtaaagaatccccgaagggcca

SEQ ID NO: 319074 - DNA, 763 bp, Homo sapiens
ggccagccctcggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaatttctgctcaagtagtatcagtgatcatttaaaatttggaggggtctttggtttacagccatgtgacaattaaaagcactaaagggagatcatgttaaagctctcaagctctggcaaggggagctctggcaaggggagctctgccagagcttgag

SEQ ID NO: 319075 - DNA, 1686 bp, Homo sapiens
  misc_feature (1686)..(1686): n is a, c, g, or t
ccgggcgcggtggcgcgtgggggtagtggtcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctggggtgttttttcatgcagttaccatgaactaatactacaataaaggatggtcttgggtgtcggaaaaaaaaaaaaaaaaaaaaaaaaaaaaaacatgtcgcccggagcggcggggtcgactgacggtaacggggcagagaggctgttcgcagagctgcggaagatgttgtggtatttgagaagaacactgagtcaccattgccacagactctgatatcggtactgctggtaggccatccatccaaatctagaaagtttctattgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaatttctgctcaagtagtatcagtgatcatttaaaatttggaggggtctttggtttacagccatgtgacaattaaaagcactaaagggagatcatgttaaagctcttaatttatattaaaacagtagcctttgtctttaaaaaagttgttgctcatgaatattataaaatgatctacaggtttcaattcaacctgtttctaggtttttttgtaaatttagttttgattaagcattataagcatttgagtctataaactttatagtagcatctttcagaataaacatttttaattgatttcagtggcaactctcaaattgattacaatatgagatatatcagtgtcgtccattaacactcataagaataatatttactgtgtcagtgctattttaggattatagttattgtttgattatttcaggttgaaaagtagaagttccaaggttttgattttggtctggtctttaagtgaaaaattaaagcaaccagtagatgtaggttaaacttttacttcatagacttaatatgtaattaatatattgccaagcaacactgttaaagaaaagtaaaactcattttttcttgttcttaatttatatattacaagatactgtaaggtattctttatgaagttgatatataaaaatttacatttttagaacattagtgaatggatcatcttttacaattaaaagtatattttgattatcagtttcttagn

SEQ ID NO: 319076 - DNA, 954 bp, Homo sapiens
ggccagccctcggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaaaaaaaaaacaaaaaaaaaaaaaaaaaaaaaaaaaaaaaaaaaaaaaaaaaaaaaaggggggggggggtaaaaaaaccacgagggggggacaacaaatacacgaccaccggttatatttgaaaaaggggcccataaagaagagaataataaacgagcagggggcggtaaaacacgcgcgagcgggaacaagcgccccgcggcacacacgggaggagacaacccaacacggggggggggccaacatggggcaacccccccaagcaaaagcgcccggggcaacacaaaccaaggcgatcacgcgcacaaccccaacatgcgggcaaaaatgccagaggaaactagaatg

SEQ ID NO: 319077 - DNA, 1055 bp, Homo sapiens
ggccagccctcggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaaaaaaaaaacaaaaaaaaaaaaaaaaaaaaaatttgggggcgcgcgcgccgcgcggcccccgcgagaaagagcgtttttagaaacccaatgcgcggtgggggcgcgcgcggggccccggagagggtaagagggaaaccgggggcacaaagcgcgggtccccagaggagagaaccgcggggcccacgagaacaagagaggggcgcggggatctctcctctcaccaacatatataaaaaacaggccgcgggggggcaaccaacaccgcgagcggcttctcttgtgagaacacataattctcgcagagagaagggagagaactcgcgagagagggggcacaaaatagcgggggggcacccttaatatccaaagacgggggagctccccaaaaggcgagagcccccgaaaaatcatacaaaatttaagcccccgcgacgagcggggggggat

SEQ ID NO: 319078 - DNA, 1299 bp, Homo sapiens
ccgggcgcggtggcgcgtgggggtagtggtcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctggggtgttttttcatgcagttaccatgaactaatactacaataaaggatggtcttgggtgtcggaaaaaaaaaaaaaaaaaaaaaaaaaaaaaacatgtcgcccggagcggcggggtcgactgacggtaacggggcagagaggctgttcgcagagctgcggaagatgttgtggtatttgagaagaacactgagtcaccattgccacagactctgatatcggtactgctggtaggccatccatccaaatctagaaagtttctattgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaatttctgctcaagtagtatcagtgatcatttaaaatttggaggggtctttggtttacagccatgtgacaattaaaagcactaaagggagatcatgttaaagctcttaatttatattaaaacagtagcctttgtctttaaaaaagttgttgctcatgaatattataaaatgatctacaggtttcaattcaacctgtttctaggtttttttgtaaatttagttttgattaagcattataagcatttgagtctataaactttatagtagcatctttcagaataaacatttttggcacaaaaaaaaaaagggggggggtaaagaatccccgaagggcca

SEQ ID NO: 319079 - DNA, 1223 bp, Homo sapiens
  misc_feature (1223)..(1223): n is a, c, g, or t
cctcaaaatacatgcacaccaggtaggattattgttaatgaaaagtataatttcagtgtctttacaacttagtttgtgtctaaaatatgaactagtgtttttttccacttgttaaattgatcttgtatttggttttgcgaattttcaaacaaagaataaagaacatgaaattagactatatattctgtcattttcccctgagttttttctaatcttgtcccttcatacttttccccaaaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaatttctgctcaagtagtatcagtgatcatttaaaatttggaggggtctttggtttacagccatgtgacaattaaaagcactaaagggagatcatgttaaagctcttaatttatattaaaacagtagcctttgtctttaaaaaagttgttgctcatgaatattataaaatgatctacaggtttcaattcaacctgtttctaggtttttttgtaaatttagttttgattaagcattataagcatttgagtctataaactttatagtagcatctttcagaataaacatttttaattgatttcagtggcaactctcaaattgattacaatatgagatatatcagtgtcgtccattaacactcataagaataatatttactgtgtcagtgctattttaggattatagttattgtttgattatttcaggttgaaaagtagaagttccaaggttttgattttggtctggtctttaagtgaaaaattaaagcaaccagtagatgtaggttaaacttttacttcatagacttaatatgtaattaatatattgccaagcaacactgttaaagaaaagtaaaactcattttttcttgttcttaatttatatattacaagatactgtaaggtattctttatgaagttgatatataaaaatttacatttttagaacattagtgaatggatcatcttttacaattaaaagtatattttgattatcagtttcttagn

SEQ ID NO: 319080 - DNA, 1227 bp, Homo sapiens
  misc_feature (1227)..(1227): n is a, c, g, or t
aaacttttgtcaatctgttttttctttttaaatccactattttgagatattattgacatacaataaagtacacctatttttaagtgtacagttctgtgggttttaattaacatggaacctggtctcctaaacagaggagtagaatgttttcattgcctcacaaagttcccttggtcccttttcagtcagtcaccccaccccagccccaggcaatcactggtttgttttctataactttaggttagttttgactcttctggattcttatgtaagcagaatcattgaatgtatctcttttttgagagtcttttaaaatgtttgtttttgtttgctttcagatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaatttctgctcaagtagtatcagtgatcatttaaaatttggaggggtctttggtttacagccatgtgacaattaaaagcactaaagggagatcatgttaaagctcttaatttatattaaaacagtagcctttgtctttaaaaaagttgttgctcatgaatattataaaatgatctacaggtttcaattcaacctgtttctaggtttttttgtaaatttagttttgattaagcattataagcatttgagtctataaactttatagtagcatctttcagaataaacatttttaattgatttcagtggcaactctcaaattgattacaatatgagatatatcagtgtcgtccattaacactcataagaataatatttactgtgtcagtgctattttaggattatagttattgtttgattatttcaggttgaaaagtagaagttccaaggttttgattttggtctggtctttaagtgaaaaattaaagcaaccagtagatgtaggttaaacttttacttcatagacttaatatgtaattaatatattgccaagcaacactgttaaagaaaagtaaaactcattttttcttgttcttaatttatatattacaagatactgtaaggtattctttatgaagttgatatataaaaatttacatttttagaacattagtgaatggatcatcttttacaattaaaagtatattttgattatcagtttcttagn

SEQ ID NO: 319081 - DNA, 606 bp, Homo sapiens
ggccagccctcggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgag

SEQ ID NO: 319082 - DNA, 579 bp, Homo sapiens
tgggctgcaggaattcggcacgaggggagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgag

SEQ ID NO: 319083 - DNA, 1524 bp, Homo sapiens
ccgggcgcggtggcgcgtgggggtagtggtcagcttccaaaggcacaggccaagttgtagctttgtcccttgccatcatgcccaacaagaggttctataccttttaatgaattgactttcataaattggttatgttggtgggcaagttctttaagctggaaattgtaaattcctcctggggtgttttttcatgcagttaccatgaactaatactacaataaaggatggtcttgggtgtcggaaaaaaaaaaaaaaaaaaaaaaaaaaaaaacatgtcgcccggagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaatttctgctcaagtagtatcagtgatcatttaaaatttggaggggtctttggtttacagccatgtgacaattaaaagcactaaagggagatcatgttaaagctcttaatttatattaaaacagtagcctttgtctttaaaaaagttgttgctcatgaatattataaaatgatctacaggtttcaattcaacctgtttctaggtttttttgtaaatttagttttgattaagcattataagcatttgagtctataaactttatagtagcatctttcagaataaacatttttaattgatttcagtggcaactctcaaattgattacaatatgagatatatcagtgtcgtccattaacactcataagaataatatttactgtgtcagtgctattttaggattatagttattgtttgattatttcaggttgaaaagtagaagttccaaggttttgattttggtctggtctttaagtgaaaaattaaagcaaccagtagatgtaggttaaacttttacttcatagacttaatatgtaattaatatattgccaagcaacactgttaaagaaaagtaaaactcattttttcttgttcttaatttatatattacaagatactgtaaggtattctttatgaagttgatatataaaaatttacattttt

SEQ ID NO: 319084 - DNA, 788 bp, Homo sapiens
  misc_feature (749)..(749): n is a, c, g, or t
  misc_feature (763)..(763): n is a, c, g, or t
  misc_feature (765)..(765): n is a, c, g, or t
ggccagccctcggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaatttctgctcaagtagtatcagtgatcatttaaaatttggaggggtctttggtttacagccatgtgacaattaaaagcactaaagggagatcatgttaaagctcttaatttatattaaaacagtagcctttgtctttaatangttttttggaaatnantttgataagcctattagcattga

SEQ ID NO: 319085 - DNA, 766 bp, Homo sapiens
ggccagccctcggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaaaaaaaaaaaaaaaaaaaaaaaaaaaacttgggggttttttttgggggggggaaaaaagggttattgaatgggattgtttttgtttttctggaccgttttttttcaggggtaaatggggtccctaaggggggatattgtagcgttttttttgaagaatg

SEQ ID NO: 319086 - DNA, 478 bp, Homo sapiens
  misc_feature (403)..(403): n is a, c, g, or t
ggccagccctcggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttttttggnaaaaaggggggggggcgcgccccgcccttttttttaaaaaaaaaaatttttggggggaatcaatgggagagccat

SEQ ID NO: 319087 - DNA, 594 bp, Homo sapiens
  misc_feature (66)..(66): n is a, c, g, or t
gggggagggtgagcccgagagaggagggggggatggggggggggattgattggggtggggaattanattgggcacgcctggaggctggaggttgatgatgctaagcacctacactactttaagaatttggaactgaaacatgaagaggaagacagaaataagaatttgggaacctgaatagctctgcaaaaaacaccaaaggaccgttttatcgttttctgttgttgctgtggtggagtgatgcagtgggcactgccggtgggccagggggcgggtgcgcatgtggtagaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattgccagggcccgtgttgaagtgtcaagagagcaatcatcaatgataatgtattgtgtgagacctttgcatcttgtaaattttctcttttttctaaaaataaataataataaaatcctaaatctcaacaaa

SEQ ID NO: 319088 - DNA, 1375 bp, Homo sapiens
tgggtgggctatcgccaggccgagagtgggcgtggccgacgtggggtgggtagcagccgaccgagtcggaccggccagttgggcgcgcttccgggtgtcacctccagagggcgccggctgcggagccgccctcagagtcgcgaggccggacgcagcgcggcgccgccccactcgccccagccgccgccatgaaggccgtggtgcagcgcgtcacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaaggaaagaaacactccccgaaaagaagaccgcagtgccagcagcggggctgagggcgacgtgtcctctgaacgggagccgtagctcaggaggcagaattcagtgtgttatcattgggcagaactggatcctgaaaaattcaagatgctaagcacctacactactttaagaatttggaactgaaacatgaagaggaagacagaaataagaatttgggaacctgaatagctctgcaaaaaacaccaaaggaccgttttatcgttttctgttgttgctgtggtggagtgatgcagtgggcactgccggtgggccagggggcgggtgcgcatgtggtagaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattgccagggcccgtgttgaagtgtcaagagagcaatcatcaatgataatgtattgtgtgagacctttgcatcttgtaaattttctcttttttctaaaaataaataataataaaatcctaaatctcaacaaa

SEQ ID NO: 319089 - DNA, 1407 bp, Homo sapiens
tgggtgggctatcgccaggccgagagtgggcgtggccgacgtggggtgggtagcagccgaccgagtcggaccggccagttgggcgcgcttccgggtgtcacctccagagggcgccggctgcggagccgccctcagagtcgcgaggccggacgcagcgcggcgccgccccactcgccccagccgccgccatgaaggccgtggtgcagcgcgtcacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaaggaaagaaacactccccgaaaagaagaccgcagtgccagcagcggggctgagggcgacgtgtcctctgaacgggagccgtagctcaggaggcagaattcagtgtgttatcattgggcagaactggatcctgaaaaattcaagatgctaagcacctacactactttaagaatttggaactgaaacatgaagaggaagacagaaataagaatttgggaacctgaatagctctgcaaaaaacaccaaaggaccgttttatcgttttctgttgttgctgtggtggagtgatgcagtgggcactgccggtgggccagggggcgggtgcgcatgtggtagaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattgccagggcccgtgttgaagtgtcaagagagcaatcatcaatgataatgtattgtgtgagacctttgcatcttgtaaattttctcttttttctaaaaataaataataataaaatcctaaatctcaacaaaaacaaaccactttattatcaaacaaaaactgc

SEQ ID NO: 319090 - DNA, 1179 bp, Homo sapiens
  misc_feature (994)..(995): n is a, c, g, or t
  misc_feature (998)..(998): n is a, c, g, or t
tgggtgggctatcgccaggccgagagtgggcgtggccgacgtggggtgggtagcagccgaccgagtcggaccggccagttgggcgcgcttccgggtgtcacctccagagggcgccggctgcggagccgccctcagagtcgcgaggccggacgcagcgcggcgccgccccactcgccccagccgccgccatgaaggccgtggtgcagcgcgtcacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaaggaaagaaacactccccgaaaagaagaccgcagtgccagcagcggggctgagggcgacgtgtcctctgaacgggagccgtagctcaggaggcagaattcagtgtgttatcattgggcagaactggatcctgaaaaattcaagatgctaagcacctacactactttaagaatttggaactgaaacatgaagaggaagacagaaataagaatttgggaacctgaatagctctgcaaaaaacaccaaaggaccgttatcgnncgngtgcgggtggatgacagggattggccgtggcaggcgggccttgaaaggtcgcggccccaaagttgggttcccacggggttggaaggccacactttaacaagggtatagccggggcaaacaagtttagcggaggagaaaatgggctgtttacccaaagtggccgctttctcctttcgctatt

SEQ ID NO: 319091 - DNA, 1019 bp, Homo sapiens
tgggtgggctatcgccaggccgagagtgggcgtggccgacgtggggtgggtagcagccgaccgagtcggaccggccagttgggcgcgcttccgggtgtcacctccagagggcgccggctgcggagccgccctcagagtcgcgaggccggacgcagcgcggcgccgccccactcgccccagccgccgccatgaaggccgtggtgcagcgcgtcacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaaggaaagaaacactccccgaaaagaagaccgcagtgccagcagcggggctgagggcgacgtgtcctctgaacgggagccgtagctcaggaggcagaattcagtgtgttatcattgggcagaactggatcctgaaaaattcaagatgctaagcacctacactactttaagaatttggaactgaaacatgaagaggaagagaccaagaaataaaacctcccactttgtctgtacatactggcctctgtgattacatagatcagccattaaaataaaacaagcctta

SEQ ID NO: 319092 - DNA, 790 bp, Homo sapiens
  misc_feature (80)..(80): n is a, c, g, or t
ctcgattgtcacgatgcttgtctagtatttattaactcctcttctagatagcggtggctgtgctttagctggttaacagnctgtcaaagctcgaaaaacagcagcagaggaaagaaaagaccagagctaagggaccttctgaatcaagcaaggaaagaaacactccccgaaaagaagaccgcagtgccagcagcggggctgagggcgacgtgtcctctgaacgggagccgtagctcaggaggcagaattcagtgtgttatcattgggcagaactggatcctgaaaaattcaagatgctaagcacctacactactttaagaatttggaactgaaacatgaagaggaagacagaaataagaatttgggaacctgaatagctctgcaaaaaacaccaaaggaccgttttatcgttttctgttgttgctgtggtggagtgatgcagtgggcactgccggtgggccagggggcgggtgcgcatgtggtagaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattgccagggcccgtgttgaagtgtcaagagagcaatcatcaatgataatgtattgtgtgagacctttgcatcttgtaaattttctcttttttctaaaaataaataataataaaatcctaaatctcaacaaa

SEQ ID NO: 319093 - DNA, 1035 bp, Homo sapiens
tgggtgggctatcgccaggccgagagtgggcgtggccgacgtggggtgggtagcagccgaccgagtcggaccggccagttgggcgcgcttccgggtgtcacctccagagggcgccggctgcggagccgccctcagagtcgcgaggccggacgcagcgcggcgccgccccactcgccccagccgccgccatgaaggccgtggtgcagcgcgtcacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaaggaaagaaacactccccgaaaagaagaccgcagtgccagcagcggggctgagggcgacgtgtcctctgaacgggagccgtagctcaggaggcagaattcagtgtgttatcattgggcagaactggatcctgaaaaattcaagatgctaagcacctacactactttttattgccagggcccgtgttgaagtgtcaagagagcaatcatcaatgataatgtattgtgtgagacctttgcatcttgtaaattttctcttttttctaaaaataaataataataaaatcctaaatctcaacaaa

SEQ ID NO: 319094 - DNA, 630 bp, Homo sapiens
acccactactggctgacccactactggctgacccactactggctgacccactactgtccaacgggagccgtagctcaggaggcagaattcagtgtgttatcattgggcagaactggatcctgaaaaattcaagatgctaagcacctacactactttaagaatttggaactgaaacatgaagaggaagacagaaataagaatttgggaacctgaatagctctgcaaaaaacaccaaaggaccgttttatcgttttctgttgttgctgtggtggagtgatgcagtgggcactgccggtgggccagggggcgggtgcgcatgtggtagaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattgccagggcccgtgttgaagtgtcaagagagcaatcatcaatgataatgtattgtgtgagacctttgcatcttgtaaattttctcttttttctaaaaataaataataataaaatcctaaatctcaacaaa

SEQ ID NO: 319095 - DNA, 1039 bp, Homo sapiens
tgggtgggctatcgccaggccgagagtgggcgtggccgacgtggggtgggtagcagccgaccgagtcggaccggccagttgggcgcgcttccgggtgtcacctccagagggcgccggctgcggagccgccctcagagtcgcgaggccggacgcagcgcggcgccgccccactcgccccagccgccgccatgaaggccgtggtgcagcgcgtcacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattgccagggcccgtgttgaagtgtcaagagagcaatcatcaatgataatgtattgtgtgagacctttgcatcttgtaaattttctcttttttctaaaaataaataataataaaatcctaaatctcaacaaa

SEQ ID NO: 319096 - DNA, 881 bp, Homo sapiens
ccggctgcctaggaccttcctgttgatgatgccatctttatggagaatatctgttccaaaggcctccaccacaggctggtaggcagggccacctggggcataggcccgatgacccaggtggtcactgtcaatgacaaacgcccccaggcccttcagtcgctgagctattgagctcttcccagagccactgatgccagtcagcccaattacatagagacatgtggggagctctggcctttcatatggaggccgaagcaggttccccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattgccagggcccgtgttgaagtgtcaagagagcaatcatcaatgataatgtattgtgtgagacctttgcatcttgtaaattttctcttttttctaaaaataaataataataaaatcctaaatctcaacaaa

SEQ ID NO: 319097 - DNA, 429 bp, Homo sapiens
gaaatacatcattgttgcaacgttgtatttattttaatacctgccttcccaagagtgcatgtttacggtgcactcctgagtactgtggccggtgggtacagcacttctcccttgcctcgtcctgcctttgaattccagaggacatgtcctgtgcagagccaggttcttcccctgggcttcccttcccttggccaggtgccgtggcgcccacctgcccctgggtggcagcagagcaatggccctggattggccggttcacccattccgaatggttacctgaattgggtttggtcccaggtgtggatagatgtgccccccaaggtttgctgtaaatctccatttttctaaagcagtgtctgacctggatttgctgccaatttgtaagctttcatgaaataaaagttaattaaaatagagaaaggaaatgtg

SEQ ID NO: 319098 - DNA, 2143 bp, Homo sapiens
tgggtgggctatcgccaggccgagagtgggcgtggccgacgtggggtgggtagcagccgaccgagtcggaccggccagttgggcgcgcttccgggtgtcacctccagagggcgccggctgcggagccgccctcagagtcgcgaggccggacgcagcgcggcgccgccccactcgccccagccgccgccatgaaggccgtggtgcagcgcgtcacccgggccagcgtcacaggtcagtcgggcggggccgggcccgggaggagccgcccctgacccccgcgaccggctgtcttgcgtggggggtcttcctgcgccatccttggggccgctgcggcccctccgcgagcctggtccccttcgcgagctcggtccgcgcagccgcgagtccccagggccggcttcggggcagcgcggcggccggagagccccctgcacgtgcccgaccggccccggcgcgcccctggcttccggctctcggcagagggtgcaggaccagcgcgcctcattctcagcacctttgtcctgcgtgcgggatggcggagcctcggagcatctccgtggtccgctcttcagggagtgttgatgaaccacgcttagagcatttccggagcaggcactcctcccttttcactgctgtattttaaatgttcaatttttgcccatttttacgtattccaatttttatggggcttgactcaggatgaaatgcacagatgcggagagttgctccttgggctgagctttgacagttgcgtgcacgtacgtgactggagcctaggctggatgaggggcgccccctgcccaggacgcccctcgccctcgcccgctgaactctgcgcggaggggtcgggatctaaagaattcaagatgaaaacatttctctttttcttgtggaccaagctacccgacccctggtcatcactcagcactttcgtctcggttgggcatcagaggtccagatgattagtgtagataaagtagtcgttttaagaaaaccacgttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaaggaaagaaacactccccgaaaagaagaccgcagtgccagcagcggggctgagggcgacgtgtcctctgaacgggagccgtagctcaggaggcagaattcagtgtgttatcattgggcagaactggatcctgaaaaattcaagatgctaagcacctacactactttaagaatttggaactgaaacatgaagaggaagacagaaataagaatttgggaacctgaatagctctgcaaaaaacaccaaaggaccgttttatcgttttctgttgttgctgtggtggagtgatgcagtgggcactgccggtgggccagggggcgggtgcgcatgtggtagaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattgccagggcccgtgttgaagtgtcaagagagcaatcatcaatgataatgtattgtgtgagacctttgcatcttgtaaattttctcttttttctaaaaataaataataataaaatcctaaatctcaacaaa

SEQ ID NO: 319099 - DNA, 1010 bp, Homo sapiens
gagtagtgtattaaccttggaggagtgaggggacaggctagcggcacaactctgttaatataccaccgctacacaactggctgctgcagcatctgcatgctttccatgcagcatacccatcacattataggctgctgcgtgggtttcatgctatgtcctggcagtgagaagttggaaggagagcattacattcttgctccaaatgacatatttccaaagggaacaggacatggaagcagcagcagaaccaactgactgctgttttgcctggtgcattttttgcaggagaacacgattctgctgtcaaagctcgaaaaacagcagcagaggaaagaaaagaccagagctaagggaccttctgaatcaagcaaggaaagaaacactccccgaaaagaagaccgcagtgccagcagcggggctgagggcgacgtgtcctctgaacgggagccgtagctcaggaggcagaattcagtgtgttatcattgggcagaactggatcctgaaaaattcaagatgctaagcacctacactactttaagaatttggaactgaaacatgaagaggaagacagaaataagaatttgggaacctgaatagctctgcaaaaaacaccaaaggaccgttttatcgttttctgttgttgctgtggtggagtgatgcagtgggcactgccggtgggccagggggcgggtgcgcatgtggtagaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattgccagggcccgtgttgaagtgtcaagagagcaatcatcaatgataatgtattgtgtgagacctttgcatcttgtaaattttctcttttttctaaaaataaataataataaaatcctaaatctcaacaaa

SEQ ID NO: 319100 - DNA, 1185 bp, Homo sapiens
tgggtgggctatcgccaggccgagagtgggcgtggccgacgtggggtgggtagcagccgaccgagtcggaccggccagttgggcgcgcttccgggtgtcacctccagagggcgccggctgcggagccgccctcagagtcgcgaggccggacgcagcgcggcgccgccccactcgccccagccgccgccatgaaggccgtggtgcagcgcgtcacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaaggaaagaaacactccccgaaaagaagaccgcagtgccagcagcggggctgagggcgacgtgtcctctgaacgggagccgtagctcaggaggcagaattcagtgggcactgccggtgggccagggggcgggtgcgcatgtggtagaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattgccagggcccgtgttgaagtgtcaagagagcaatcatcaatgataatgtattgtgtgagacctttgcatcttgtaaattttctcttttttctaaaaataaataataataaaatcctaaatctcaacaaa

SEQ ID NO: 319101 - DNA, 904 bp, Homo sapiens
tgggtgggctatcgccaggccgagagtgggcgtggccgacgtggggtgggtagcagccgaccgagtcggaccggccagttgggcgcgcttccgggtgtcacctccagagggcgccggctgcggagccgccctcagagtcgcgaggccggacgcagcgcggcgccgccccactcgccccagccgccgccatgaaggccgtggtgcagcgcgtcacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattcagaatgatgggcctgtgaccatagagctggaatcgccagctcccggcactgctacctctgacccaaagcaggccaggtgccgtggcgcccacctgcccctgggtggcagcagagcaatggccctggattggccggttcacccattccgaatggttacctgaattgggtttggtcccaggtgtggatagatgtgccccccaaggtttgctgtaaatctccatttttctaaagcagtgtctgacctggatttgctgccaatttgtaagctttcatgaaataaaagttaattaaaatagagaaaggaaatgtg

SEQ ID NO: 319102 - DNA, 1533 bp, Homo sapiens
accccagattgctacaaaccgaaggctaaaatagaggtcagcaatcattcatattgtgtaaaatgtcacccttagctagcaatttatttttccatatttgtgtgtttagtgcactgttagaattccttttcctcacttttgttttgttcatggcacttcataattttatcatttcattttattttcagttgatatctggtcagtgggttgcatcatgggagagctggtgaaaggttgtgtgatattccaaggcactgaccgtatccttccccgcgaccttggccccgccatgctttcttaatgcctcaggcagcatgaccacctgcttacacgagcgctcacgaggacaaagtcgtaaaatccactccagactgtgttctaaggggggctttactgtatttgttaattagtgtcacaagccaagtggttcaatttcattctttatttttaacttgactacctgtgatgactttgagacttagagttcagttaaaccgattatattagctcttaattttgccaaaaatagctggacacatagaagaaattatttactctttgataagtatattctgatatttaaatgaaaatactgtattatttagtttattccgttaatttaactaggaaagatgctatctaaatttaataggctagtgtgcttgtgtgctttaattaagtactattttgttagttactggtatgcattgaaatattttcccccaaagtaagaactgaagcacattacaaaggacctaagtgaaagagattaaaatgaaaattttgtgaggaacaatatgttaaactttcttgtttgttactgtgctgacattttgtagaattttttttaaaaatctgtctagtgggttattttgtgacacactggggaagtcaaaataaatgtaaaatgaaagagataaactcatactgtagtcagcaagtcatgttagagatacagcagaaaggagaataactactctaattgttacaatagccttctttcctcatttgccattcttccatcctcagtattttttaccctaacatggttcttcacatcttccctttttcatttgtgttttaaccacttagtttttcattagtctttgactttgttttcgttatgaaagtttaaattggtctccatccttgggcagattgatggttgcttttaaggaaatcaagctccatagtcagtgttttgtatgtatcttaggaaaataatttcagattttaataattttatcaaagtggtctccttataaattcttcacagtgcaaacttaaagtgaaaatatttttatttctctcattttatttacctttctttacattttctatatcatagattatataatatgtcaagttattttatttgttctactaaattttctagcagtttccatagcctcatctcagattcacttgttgcaacctataaataaggacgtctttattttgcaagtaaacttaattaaaaagggaaaagttgaaaaattaaaagactaataatttagaaatatctacttaatg

SEQ ID NO: 319103 - DNA, 720 bp, Homo sapiens
actccgtctccgaaaaaaaaaaaaaaaattttgggttatattcatcttgaacctatcaaacatttctcaaaattaatatatctttgttctatctgtgttgtcatatttagttctttattgtatgattctgtttgtttcatattaacagcattaatttaatatttgttgtcaccctagcaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 319104 - DNA, 522 bp, Homo sapiens
gagttagtacatgctgtagtcttagacaactcactctgctcttcatatgtgcaagtaccttgaatgaaataagcagatttttccttgttacttattaaaaagatgatatattcaatgtatattctggcattgctgtattttccaaaaccgttctaatggattgtgcattatatttcctaattctagtgctgcatttgatacagttcttgggataaatgttgcagtcaagaaactaagccgtccttttcagaaccaaactcatgcaaagagagcttatcgtgaacttgtcctcttaaaatgtgtcaatcataaaaatgtaagttatgtatgtattttgtctgtgtgcttccatattgtcaataatgtggtaatcttcagggttttctggagatacattgagttcagacctaggataagctaaggataaaaatggctattaacattggttttttgttttttgtttttttgtttttttgtcgccattgcactccagcctgggggacaagaatgaaactccatctc

SEQ ID NO: 319105 - DNA, 4158 bp, Homo sapiens
caaactacgtgctgtacagctgcatcagctgctcgtagacatgtccagcagctggtcgaggtccacgccgcggtaggtgaagttgcggaaggtccggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtgtacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgactgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 319106 - DNA, 4459 bp, Homo sapiens
caaactacgtgctgtacagctgcatcagctgctcgtagacatgtccagcagctggtcgaggtccacgccgcggtaggtgaagttgcggaaggtccggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtgtacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgactgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaaaataaaaaacaaccgaaactaaatcagcggcagacgaaaagaaagacatacgcaaagcaagggcggcggcgccaaaaaaaatcccacgcggggggcgacacagtgacggacgaccacagcgtctgtgggcaacaaggggccgcatatagagaggcagaaaaaaaccggcacgcgcggcggtaaaaagaggggcggaacacggcccgggaccttgggagcaccaatcctggggcgcacaacgggaaac

SEQ ID NO: 319107 - DNA, 4242 bp, Homo sapiens
tcgtcggggatttcctgcttcaacagtgcttggacggaacccggcgctcgttccccaccccggccggccgcccatagccagaccctccgtcacctcttcacctgcacccggcaggcggagccggggccgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtgtacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgactgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 319108 - DNA, 4023 bp, Homo sapiens
caaactacgtgctgtacagctgcatcagctgctcgtagacatgtccagcagctggtcgaggtccacgccgcggtaggtgaagttgcggaaggtccggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtgtacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgactgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccattccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 319109 - DNA, 2946 bp, Homo sapiens
caaactacgtgctgtacagctgcatcagctgctcgtagacatgtccagcagctggtcgaggtccacgccgcggtaggtgaagttgcggaaggtccggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtgtacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgta

SEQ ID NO: 319110 - DNA, 3636 bp, Homo sapiens
accccagattgctacaaaccgaaggctaaaatagaggtcagcaatcattcatattgtgtaaaatgtcacccttagctagcaatttatttttccatatttgtgtgtttagtgcactgttagaattccttttcctcacttttgttttgttcatggcacttcataattttatcatttcattttattttcagttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtgtacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgactgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 319111 - DNA, 3827 bp, Homo sapiens
aacctttccttatgagcatgcctgtgttgggttgacactcgtgccgaattcggcacgagagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgtggacatctggtctgtcgggtgcatcatggcagaaatggtcctccataaagtcctgttcccgggaagagactatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtgtacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgactgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 319112 - DNA, 2718 bp, Homo sapiens
gagcctcggttactccttcgactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtgtacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgactgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 319113 - DNA, 2420 bp, Homo sapiens
gcacgaggagagagagagagagagagagagagagagaacctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtgtacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgactgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 319114 - DNA, 2177 bp, Homo sapiens
cgccgcggcggcggcagcggcggagaagggagcgggaccggaagggtcgcagcgccccggcgcccctcacacccactgcggcggcggcggcggcggcggcggcggggcggagcggagcggggcgggccggcggcggagccggggccgcggagccaggagtgactagcacgcagcgccgccagtccgcccgcccgccctctccccgtggcgcggcgggcggggaggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcaggttagtgattgctttaattgattgtatgatatttttctttccctattcaactttttttttttgagacagagtttcgttctgtcgcccaggctggagagcagcggcgcgatctctgctcactgcaacctccacctcctgggttcaagcaattctcctgcctcagcctcccgagtagctgggactacaggcacgcgccaccatgccctgctaatttttgtatttttagtagagacggggtttcaccatattggccaagctggtctcgatctcctgaccttgtgatctgcccgcctcagcctcccaaagtggtgggattacaggcacgcaccaccatgcctggctaatttttgtatttttagtagagacggggtttcagcatattggccaagctggtctcgatctcctgacctcgtgatccacccgcctcagcctcccaaagtggtggggttacaggcgtgagccaccgcacctggcgtctttcccgattcaacttttataaatggcagcaacatgtgaaatgccagcctggctagcatcagatttaaaaaccgctgtatgaatagccagcctttttggcttgtcatagtggtggtggtggtggatgacattttactgatgtgccaggcactgaactttgttataagcatttctctttcatctttgcaataactgctgtcacctccatttacagatgaagaaattgaatttaaagccttttcaatgttgataaccctttgtactggtcccacccaaaatgccaatctaagta

SEQ ID NO: 319115 - DNA, 1726 bp, Homo sapiens
cgccgcggcggcggcagcggcggagaagggagcgggaccggaagggtcgcagcgccccggcgcccctcacacccactgcggcggcggcggcggcggcggcggcggggcggagcggagcggggcgggccggcggcggagccggggccgcggagccaggagtgactagcacgcagcgccgccagtccgcccgcccgccctctccccgtggcgcggcgggcggggaggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaagtaagatatcctttttttcttatacttgtgttttgtaattcaggtggtgctttcactctttcatgtttgtattctaaaaacctgtgttttgggagagaaagtcattttaggcctgaagtctgaggtacgaaggcactgaggagagaaagcttaaaggtctagaagctttatcctctataagacggcttaattgaagcctttggccaaaataaaaataatcaaatcagtctgaaagaatcttatgttacagttacagcaactggaattcaaaaagttttcaggtaagaagaacacttaatgcagattctagagtcagaagcgatgtgacagttgttcgatgaaaaaggtccttcctccccaccttctcctgcaccctttactacagtgtgattgtttaaggaaaaagaaaagatttgattctgtccgcatgaaggtaaactgtgccttaatcagaaaagccccagtctttgcttattcaggttgtgaactttaattgacaaaacctaggtgagccttatatttaactaagttattgaacttgtttttctttttcctaaataccaatctgtagattaaaaa

SEQ ID NO: 319116 - DNA, 563 bp, Homo sapiens
ctttcagattgcatatctcaaaagtaacattgctaatgttttataataaaatatattatgtgtgttttggttggtgaaaataatacagactacattttaaaagataaatgtatagcatgtccaatttttgtgtgtttttacatggcaattagatatttctccatcaccatctctgatgacagatttaacatgaacacagatagatgataaagtgtcatgcttttgatcaatattagcaagaggtttcacactgagaggcagaaacattgctgtttgttctcttattgaaaatattctgcaaattcctaaatctgtgttttcaaaactaatggcagtaagttttgacttcaccaatatgcaggtccaattcagagtattggtgtaattgttttctcatgaggcgtggccaggagaattcaccagtcagccttagtcatgttacttaacgtcattcatggtgcttgtggctttgtgcctgggatgagccaagttcatctgacgtctgtgtttgaagcacttcaggctgtttagtacttaataccacaggagtggaaggacactca

SEQ ID NO: 319117 - DNA, 4212 bp, Homo sapiens
caaactacgtgctgtacagctgcatcagctgctcgtagacatgtccagcagctggtcgaggtccacgccgcggtaggtgaagttgcggaaggtccggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtgtacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgactgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 319118 - DNA, 4340 bp, Homo sapiens
cgccgcggcggcggcagcggcggagaagggagcgggaccggaagggtcgcagcgccccggcgcccctcacacccactgcggcggcggcggcggcggcggcggcggggcggagcggagcggggcgggccggcggcggagccggggccgcggagccaggagtgactagcacgcagcgccgccagtccgcccgcccgccctctccccgtggcgcggcgggcggggaggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtgtacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgactgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 319119 - DNA, 4248 bp, Homo sapiens
caaactacgtgctgtacagctgcatcagctgctcgtagacatgtccagcagctggtcgaggtccacgccgcggtaggtgaagttgcggaaggtccggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtgtacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgactgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtggaagggagctcccttccaccagcatatcggcgccggctccatgacctcgggctttcgccagaccttca

SEQ ID NO: 319120 - DNA, 2025 bp, Homo sapiens
caaactacgtgctgtacagctgcatcagctgctcgtagacatgtccagcagctggtcgaggtccacgccgcggtaggtgaagttgcggaaggtccggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttc

SEQ ID NO: 319121 - DNA, 4581 bp, Homo sapiens
cgccgcggcggcggcagcggcggagaagggagcgggaccggaagggtcgcagcgccccggcgcccctcacacccactgcggcggcggcggcggcggcggcggcggggcggagcggagcggggcgggccggcggcggagccggggccgcggagccaggagtgactagcacgcagcgccgccagtccgcccgcccgccctctccccgtggcgcggcgggcggggaggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttggcgccatcattgcagtgccttgccattcattggcaggatgaggccagtcagtgtcattgtcactccatggattaaccaggaagggatgctgtgtgaggggttgggctggccatctcttccttggtgtctcacttcaactgtgtgtccagcccagaacgtcagaatcgttagtctgaccctgaacgttagtctcttgcatggtaagacggtcagccgccgcagcatcacgggccagctcaagtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaacaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtgtacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgactgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 319122 - DNA, 3370 bp, Homo sapiens
actccgtctccgaaaaaaaaaaaaaaaattttgggttatattcatcttgaacctatcaaacatttctcaaaattaatatatctttgttctatctgtgttgtcatatttagttctttattgtatgattctgtttgtttcatattaacagcattaatttaatatttgttgtcaccctagcaagtcaagccagagatctgttatcaaaaatgttagtgattgatcctgacaagcggatctctgtagacgaagctctgcgtcacccatacatcactgtttggtatgaccccgccgaagcagaagccccaccacctcaaatttatgatgcccagttggaagaaagagaacatgcaattgaagaatggaaagagctaatttacaaagaagtcatggattgggaagaaagaagcaagaatggtgttgtaaaagatcagccttcagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtgtacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttcagaggacgtgaaggaaataccctgaagagtcatgattaactattgactattttctgatttaaaactgctcacctgaaattgatacttttagactttacgatcagtaaattattcagaattcatgaagatgctgagtatgttaagtgtcactgcaggaacggagctgtggtgatcacgttttgcctgcctgtgcccatgtctcttcccttgagcttattctgttgctgattcatatcttgtgttcaattattttggaagcttttcagtcgacattctgtagagtgtgttctgaggaggaactgtgataagaaagtttattataaatattatgtaaaatatatggctctctctgcaccagttatatcttattggttggtcatatcactggaaactggaacctttgattagcaaaattaatattgaaataagaaatagttcttttatattgtgtcatttggacactttcaagtacaaaatggtaataataacttggattgaggcggaaacacctattttatggctatctatctaaacatcttaaaatggccttctctgtaatacactttcttttaaaagacttcactaaatctatctttaaaaggaaaaacaaaagggagaggttgaaaatgcgcgactgccctgcactgtgtgatgctccctccccgggagacgtggacgggggacgaggcacccgcagacgcccttctgctcactcgctcctctgtgcattcagcgagccacttgccacagatggagcccgtgacggtgtggagggtttcctggaaaggccatcttccaccaggtagaggcgagcgtgcctaggacaggccacagggctccacagaaatacctcaccccagcttcagggttctctctcctgagcctagatttgccagggtcttggtgccacgcaaatggtttcaaactgatctctatggataaatgctgatgttggttaaagaactgaaaaatgtgctcaactgtttcatcttttctattttatttttgtaatttatattgtacacaacccaggaagtaactattttggacatgtatttttataaaccaggtaatttactattatcctggaatttagactaggtttgtttcatttgttgacttagtttccagccaagaaggaaacgactgtctcccccatgtccaggtctcagtttcaagggcagagtccagagagcagacagagttctgtgagagcaggagagcagtctggaaaccctggctgtgcataccgtgtcagccgtgggcctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataaa

SEQ ID NO: 319123 - DNA, 2237 bp, Homo sapiens
cgccgcggcggcggcagcggcggagaagggagcgggaccggaagggtcgcagcgccccggcgcccctcacacccactgcggcggcggcggcggcggcggcggcggggcggagcggagcggggcgggccggcggcggagccggggccgcggagccaggagtgactagcacgcagcgccgccagtccgcccgcccgccctctccccgtggcgcggcgggcggggaggcgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacgttgatatctggtcagtgggttgcatcatgggagagctggtgaaaggttgtgtgatattccaaggcactgaccgtatccttccccgcgaccttggccccgccatgctttcttaatgcctcaggcagcatgaccacctgcttacacgagcgctcacgaggacaaagtcgtaaaatccactccagactgtgttctaaggggggctttactgtatttgttaattagtgtcacaagccaagtggttcaatttcattctttatttttaacttgactacctgtgatgactttgagacttagagttcagttaaaccgattatattagctcttaattttgccaaaaatagctggacacatagaagaaattatttactctttgataagtatattctgatatttaaatgaaaatactgtattatttagtttattccgttaatttaactaggaaagatgctatctaaatttaataggctagtgtgcttgtgtgctttaattaagtactattttgttagttactggtatgcattgaaatattttcccccaaagtaagaactgaagcacattacaaaggacctaagtgaaagagattaaaatgaaaattttgtgaggaacaatatgttaaactttcttgtttgttactgtgctgacattttgtagaattttttttaaaaatctgtctagtgggttattttgtgacacactggggaagtcaaaataaatgtaaaatgaaagagataaactcatactgtagtcagcaagtcatgttagagatacagcagaaaggagaataactactctaattgttacaatagccttctttcctcatttgccattcttccatcctcagtattttttaccctaacatggttcttcacatcttccctttttcatttgtgttttaaccacttagtttttcattagtctttgactttgttttcgttatgaaagtttaaattggtctccatccttgggcagattgatggttgcttttaaggaaatcaagctccatagtcagtgttttgtatgtatcttaggaaaataatttcagattttaataattttatcaaagtggtctccttataaattcttcacagtgcaaacttaaagtgaaaatatttttatttctctcattttatttacctttctttacattttctatatcatagattatataatatgtcaagttattttatttgttctactaaattttctagcagtttccatagcctcatctcagattcacttgttgcaacctataaataaggacgtctttattttgcaagtaaacttaattaaaaagggaaaagttgaaaaattaaaagactaataatttagaaatatctacttaatg

SEQ ID NO: 319124 - DNA, 801 bp, Homo sapiens
tcgtcggggatttcctgcttcaacagtgcttggacggaacccggcgctcgttccccaccccggccggccgcccatagccagaccctccgtcacctcttcacctgcacccggcaggcggagccggggccgagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttgtgctgcatttgatacagttcttgggataaatgttgcagtcaagaaactaagccgtccttttcagaaccaaactcatgcaaagagagcttatcgtgaacttgtcctcttaaaatgtgtcaatcataaaaatataattagtttgttaaatgtgtttacaccacaaaaaactctagaagaatttcaagatgtgtatttggttatggaattaatggatgctaacttatgtcaggttattcacatggagctggatcatgaaagaatgtcctaccttctttaccagatgctttgtggtattaaacatctgcattcagctggtataattcatagagactgtacatgcggcgcctgtggccctgcacctggaagctgggcatcagtttctctgcgtgaagggccagcaggagtgaggaaggagtggagcctcacttctgggatggagatggggatctgggacatctactacgtacttggactttcaataaaatgaaaacttctccaaaa

SEQ ID NO: 319125 - DNA, 1865 bp, Homo sapiens
ctgacactgaacgccgcttgtcccctccggcttgccgtcctcgcagccatggcggccgccgcgctcccagcatggctgtctctgcagtcgagggcaaggactctgcgtgcattctccactgccgtctactcggccactccggtcccgacacctagcctgccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagtaaagctttccagtttgaatttagatgatcacgcaaagaagaaattaattaaacttgtaggagagcgatactgcaagaccacagatgtgcttaccatcaaaacagataggtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcattttttttcctcagagttaaaattatttccctcatactaatgcttaatggcaatgattactccagagttttttaatttttacactggggcaatagactaggaggtctctgatttcttcttggtctaaagtgttttgattttatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttagcatcctactttctagattgtggggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgattaatttaaaatcaaaataaaggaattactgagttta

SEQ ID NO: 319126 - DNA, 1956 bp, Homo sapiens
ctgacactgaacgccgcttgtcccctccggcttgccgtcctcgcagccatggcggccgccgcgctcccagcatggctgtctctgcagtcgagggcaaggactctgcgtgcattctccactgccgtctactcggccactccggtcccgacacctagcctgccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagaaatgtaaaaaaatataatcccagcagaatgtgagaaggcctgctttcctgtgctctcaccaacctacatattacctgtcaacttgataggtaaagctttccagtttgaatttagatgatcacgcaaagaagaaattaattaaacttgtaggagagcgatactgcaagaccacagatgtgcttaccatcaaaacagataggtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcattttttttcctcagagttaaaattatttccctcatactaatgcttaatggcaatgattactccagagttttttaatttttacactggggcaatagactaggaggtctctgatttcttcttggtctaaagtgttttgattttatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttagcatcctactttctagattgtggggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgattaatttaaaatcaaaataaaggaattactgagttta

SEQ ID NO: 319127 - DNA, 2232 bp, Homo sapiens
ctgacactgaacgccgcttgtcccctccggcttgccgtcctcgcagccatggcggccgccgcgctcccagcatggctgtctctgcagtcgagggcaaggactctgcgtgcattctccactgccgtctactcggccactccggtcccgacacctagcctgccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagtaaagctttccagtttgaatttagatgatcacgcaaagaagaaattaattaaacttgtaggagagcgatactgcaagaccacagatgtgcttaccatcaaaacagataggtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcattttttttcctcagagttaaaattatttccctcatactaatgcttaatggcaatgattactccagagttttttaatttttacactggggcaatagactaggaggtctctgatttcttcttggtctaaagtgttttgattttatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttagcatcctactttctagattgtggggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgattaatttaaaatcaaaataaaggaattactgagtttaaaaaaaaaaaaaaaaaaaaaaaaaaaaaaaaaaaaaaaaaaaaaaaaaaaagggggggaaaagaaaaagaaaaaaaaaaaaaaaagttgggccgcggcgacgcgcaccccgcacaacaaaaaggtttttccgaaaccaccacctgggggggcgggcccggcccccccatcgtgagatgcagcagccatcgagacaacagctaggtctccaacgagagaatcgcgccgggtcacaaccacaagcgggcggaggtccccccccccaaaaaaaaaggcccccgcggaaaacaacgagttggcagcaccacccccgcggcgccagaccaattaggtgtcaccacagaggcccgcacgcggcggtgtaaaac

SEQ ID NO: 319128 - DNA, 1755 bp, Homo sapiens
ctgacactgaacgccgcttgtcccctccggcttgccgtcctcgcagccatggcggccgccgcgctcccagcatggctgtctctgcagtcgagggcaaggactctgcgtgcattctccactgccgtctactcggccactccggtcccgacacctagcctgccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcattttttttcctcagagttaaaattatttccctcatactaatgcttaatggcaatgattactccagagttttttaatttttacactggggcaatagactaggaggtctctgatttcttcttggtctaaagtgttttgattttatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttagcatcctactttctagattgtggggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgattaatttaaaatcaaaataaaggaattactgagttta

SEQ ID NO: 319129 - DNA, 1106 bp, Homo sapiens
ctgacactgaacgccgcttgtcccctccggcttgccgtcctcgcagccatggcggccgccgcgctcccagcatggctgtctctgcagtcgagggcaaggactctgcgtgcattctccactgccgtctactcggccactccggtcccgacacctagcctgccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagtaaagctttccagtttgaatttagatgatcacgcaaagaagaaattaattaaacttgtaggagagcgatactgcaagaccacagatgtgcttaccatcaaaacagataggtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgtta

SEQ ID NO: 319130 - DNA, 1923 bp, Homo sapiens
ctcaagggagccatcctcaccaccatgctggcattgaactttttcagacactccacagtctcctgtctgtgcatcatggatgctaccgtggagcgttggcagacccatggcggccgccgcgctcccagcatggctgtctctgcagtcgagggcaaggactctgcgtgcattctccactgccgtctactcggccactccggtcccgacacctagcctgccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagtaaagctttccagtttgaatttagatgatcacgcaaagaagaaattaattaaacttgtaggagagcgatactgcaagaccacagatgtgcttaccatcaaaacagataggtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcattttttttcctcagagttaaaattatttccctcatactaatgcttaatggcaatgattactccagagttttttaatttttacactggggcaatagactaggaggtctctgatttcttcttggtctaaagtgttttgattttatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttagcatcctactttctagattgtggggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgattaatttaaaatcaaaataaaggaattactgagttta

SEQ ID NO: 319131 - DNA, 1789 bp, Homo sapiens
cggcaagcgatatctgcgtgatgctccacctggtcgtctacggtctgacagtaccggacccgaaatctattgcgtgcgggaaagaacacccggaaatgaaagggccaccatacgaaagagaggaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagtaaagctttccagtttgaatttagatgatcacgcaaagaagaaattaattaaacttgtaggagagcgatactgcaagaccacagatgtgcttaccatcaaaacagataggtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcattttttttcctcagagttaaaattatttccctcatactaatgcttaatggcaatgattactccagagttttttaatttttacactggggcaatagactaggaggtctctgatttcttcttggtctaaagtgttttgattttatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttagcatcctactttctagattgtggggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgattaatttaaaatcaaaataaaggaattactgagttta

SEQ ID NO: 319132 - DNA, 2433 bp, Homo sapiens
ctgacactgaacgccgcttgtcccctccggcttgccgtcctcgcagccatggcggccgccgcgctcccagcatggctgtctctgcagtcgagggcaaggactctgcgtgcattctccactgccgtctactcggccactccggtcccgacacctagcctgccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagtaaagctttccagtttgaatttagatgatcacgcaaagaagaaattaattaaacttgtaggagagcgatactgcaagaccacagatgtgcttaccatcaaaacagataggtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcattttttttcctcagagttaaaattatttccctcatactaatgcttaatggcaatgattactccagagttttttaatttttacactggggcaatagactaggaggtctctgatttcttcttggtctaaagtgttttgattttatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttagcatcctactttctagattgtggggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgattaatttaaaatcaaaataaaggaattactgagtttatttgcctaatagacttattttgcctagaagaattagagagtataaatgaaagccaaaatggaatttcacaacgatttcctaaaccatttgtgtgaaatgaaggtatgatctggtgtgattgaggccaggagtctgtaggttatgaaggacaatatggccttgagtacaaaaaggagagaaagaggcatgtcgtgccctgctggggcacccttatactacttatcattttaatcctagggctgacttatgaatgaactcaaaaggggctagactgagctgaattggtaagtagtagatgaaaagcagtacagataaaaaccaaaattttagatcatgtttagagcatatttcaagaaacataccagtacatttagagactcattcggagttaagaaaaactcagattcctaacaggattgaagaaggaaacattttgaaaacagtagaagctgagaagagatgatcatttgggaacatgtaaaggagcggtagcttagggtggtttatcctgtgtaataatacagtgcagatgaaagcaaagaggaggatgtgtaataaagaatttgac

SEQ ID NO: 319133 - DNA, 1333 bp, Homo sapiens
ctcaagggagccatcctcaccaccatgctggcattgaactttttcagacactccacagtctcctgtctgtgcatcatggatgctaccgtggagcgttggcagacccatggcggccgccgcgctcccagcatggctgtctctgcagtcgagggcaaggactctgcgtgcattctccactgccgtctactcggccactccggtcccgacacctagcctgcaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcattttttttcctcagagttaaaattatttccctcatactaatgcttaatggcaatgattactccagagttttttaatttttacactggggcaatagactaggaggtctctgatttcttcttggtctaaagtgttttgattttatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttagcatcctactttctagattgtggggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgattaatttaaaatcaaaataaaggaattactgagttta

SEQ ID NO: 319134 - DNA, 744 bp, Homo sapiens
ctgacactgaacgccgcttgtcccctccggcttgccgtcctcgcagccatggcggccgccgcgctcccagcatggctgtctctgcagtcgagggcaaggactctgcgtgcattctccactgccgtctactcggccactccggtcccgacacctagcctgccggaaagaacacccggaaatgaaaggccaccaagaagaaaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgaagcccttaaagatttttgcactgagtggccagccgcactggacagtgacgagaaatgtgagaagcattttccaattgaaattgacagcactgattatgtttcatcaggaccatctgttcggaaccccagagcacgagtagtagtcttaagagtaaagctttccagtttgaatttagatgatcacgcaaagaagaaattaattaaacttgtaggagagcgatactgcaagaccacagatgtgcttaccatcaaaacagatagttcccagatggggccctttacgaggcagaataccattatccgcgttacctacagggtatcccct

SEQ ID NO: 319135 - DNA, 2253 bp, Homo sapiens
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggaaaatggcaccagggtgtgaattgtgcatcccgcggggatcactgccaccaccccctgaaccacggatttgactatttctacggcatgcccttcacgctcacaaacgactgtgacccaggcaggccccccgaagtggacgccgccctgagggcgcagctctggggttacacccagttcctggcgctggggattctcaccctggctgccggccagacctgcggtttcttctctgtctccgcgagagcagtcaccggcatggccggcgtgggctgcctgtttttcatctcttggtactcctccttcgggtttgtgcgacgctggaactgtatcctgatgagaaaccatgacgtcacggagcaacccatggttctggagaaaacagcgagtcttatgctaaaggaagctgtttcctatattgaaagacacaagcatgggccatttctcctcttcctttctttgctgcatgtgcacattccccttgtgaccacgagtgcattcctggggaaaagtcagcatggcttatatggtgataatgtggaggagatggactggctcatagccagtgacttcatgtcatcatcagaagttaccgaaagtgaagcgataaagttaatgttcaggacaatgcagagacgctgtcttccttctatggccttcaagaaaccctggagaggaccagtgaggctgcagattcttaaaagagcatagacattaaaattcttgcagaatctgaatgtgtctcctgagacaagcatcgtgatagagttcacagtcttaaaagtctgcattttcaggtggggcaaggtggctcatgcctttaatcccagcattttgggaggctaaggcagggagatggcttgagaccaggagttcaagaccagcctgggcaacatagtgagacgcccccccccccatctctacaaaaaatttaaaaaattagccatggtggtgtgcacctgtggtcccagctactccagaggctgaggtgggaagatcatttgagcccaggaggctgaggctgcaatgactgataattattgcaccactgaactccagcctgggccacatagcaagaccctgtctccaaaaaaaaaaaaaaaaaaaaaaaggaataaaggacgcagaatagggagaaaaacttctctcatatcatttatttggtccttcagtatttctgaatacttagtctaatttggcacaaaatcaactgtattagtccattcttgcaaagaaatacctgagactgggtattttataaggaaaagaggttggattggctcacgttctgcagctgcacagaagcatggcagcatctgcttctgggagacctcggggagtttttgctcatggtggaaggcgaagggggagcaggcgtcttgcggcaggagaaggaccaagagaggagaggaagagccgcacacttttaaacaaccagatctcgtgagaagctactccctccgcagcaccaagcgggggatggtgctcaaccattcatgagaactctgtccccatcattcagtcacctccccccaggccccaccgccgattctgaggatgacaattccacatgagatttgggcggggacacacatccaaactatattgtcaaccttctacacagccaatgacttaacagcctcattagaagttacagaaactaaagcaataaagttcggacaatgcagagaggtcaccttccttctatggccttgaagaaaccctggag

SEQ ID NO: 319136 - DNA, 432 bp, Homo sapiens
gatgatggatagataagatagataatggatagataagatagatgatggatggatagatgatagataatggatagatgatggatagatatttaagatacatgatggatggataaatatatagatatgtaggatagatgatagataagatacatgattgatggatagataagatagatgatagatatataagatagatgatggatagataagatagatgatagatagatagatagataaaaagtagaatcagttcatggatggatgaatagatggatggacagatagatggatgaaaggtagataaacagagatagatgataggtaggtacctgtggacggctctgcgaataggacagttgcatttcttgggaatcaagtgcatccctaggctggcagtgcagcagaaatactgaataaaatgtgacaaatctc

SEQ ID NO: 319137 - DNA, 5163 bp, Homo sapiens
  misc_feature (2056)..(2056): n is a, c, g, or t
  misc_feature (2061)..(2061): n is a, c, g, or t
  misc_feature (2192)..(2192): n is a, c, g, or t
  misc_feature (2195)..(2195): n is a, c, g, or t
  misc_feature (2264)..(2264): n is a, c, g, or t
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggaaaatggcaccagggtgtgaattgtgcatcccgcggggatcactgccaccaccccctgaaccacggatttgactatttctacggcatgcccttcacgctcacaaacgactgtgacccaggcaggccccccgaagtggacgccgccctgagggcgcagctctggggttacacccagttcctggcgctggggattctcaccctggctgccggccagacctgcggtttcttctctgtctccgcgagagcagtcaccggcatggccggcgtgggctgcctgtttttcatctcttggtactcctccttcgggtttgtgcgacgctggaactgtatcctgatgagaaaccatgacgtcacggagcaacccatggttctggagaaaacagcgagtcttatgctaaaggaagctgtttcctatattgaaagacacaagcatgggccatttctcctcttcctttctttgctgcatgtgcacattccccttgtgaccacgagtgcattcctggggaaaagtcagcatggcttatatggtgataatgtggaggagatggactggctcataggtaaggttcttaatgccatcgaagacaatggtttaaagaactcaacattcacgtatttcacctctgaccatggaggacatttagaggcaagagatggacacagccagttagggggatggaacggaatttacaaaggtgggaagggcatgggaggatgggaaggtgggatccgcgtgcccgggatcttccactggccgggggtgctcccggccggccgagtgattggagagcccacgagcctgatggacgtgttccctactgtggtccagctggtgggtggcgaggtgccccaggacagggtgattgatggccacagcctggtacccttgctgcagggagctgaggcacgctcggcacatgagttcctgtttcattactgtgggcagcatcttcacgcagcacgctggcaccagaaggacagtggaagcgtctggaaggttcattacacgaccccgcagttccaccccgagggagcgggggcctgctacggccgaggcgtctgcccatgctccggggagggcgtgacccatcacagaccccctttgctctttgacctctccagggacccctccgaggcacggcccctgacccccgactccgagcccctgtaccacgccgtgatagcaagggtaggtgccgcggtgtcggagcatcggcagaccctgagtcctgtgccccagcagttttccatgagcaacatcctgtggaagccgtggctgcagccgtgctgcggacatttcccgttctgttcatgccacgaggatggggatggcaccccctgaatgccaggactgtgagagaggatccaggagagcctgactgcgttgcaaacaaaattctccaagcttggttctatcttcagcttccctttttgcaaggaacatgccctggactgagagtgggtccccactttctttctttctttctttcttttttgagacagagtgtcgctctgtccctcaggctggantgcantggcacgatctctgctcactgcaacctccgcctcccgggttcaagcgattttcctgcctcagcctcctgagtacccaggattacaggcaccaggcacctgccaccatgcctagctaatttttgtagttttngtngagacagggtttcaccatgttgcccaggctggtctcgcactcctgacctcaagtcatccacctgcctcngcctcccaaagtgctgggattacaggcacgagccactgcgcccatgtagggtttccctttcctgatttgtgaaataagactgtcccagtaggcacccactgatgcctcctcttcctcttctaaatctcagggttcgtcattgtgccaatgcccgatgttttcacccctccgtcttaaagcattgttgcaatttcatcacctagatgacataacagccttacaaaaggacagggaggagtgtctgttcctactctcacatagcggaggaaagttagagcctctcagtctctgtttatgaggactcattaatctcaaataattgatgcatttttcatacattagggtctctgtccatgtgtcttcctgatattgttatagaaatggcttcaggctgctggtaacagatgctgcggaaaaagaatgccttaaacaaagccaggcacggtgactcacacctgtaatcccagcactttgggaggctggggtgggaggatcacttgagcctaggagttagacacctacccagcctgagcaacacagtgagacctcatctctacaaaaaacaaataattagctagatgtcgtggcgcacagctgtggtctcagctacttaggaggctgaggcgggaggattatttgagcctgggaggtcaaaactgcaatgagctaagattgcactactgcactccgggctgggagacagagtaagaccctgccttaaaaaaaaaaaaaaaaaaatgccttaaagaaaataataagagaagggtgtgttctcttccaagtaatgagccgatcaaggggaagcaacccaaggctagcaggctcttttcaattcccagctctgccactcttagcatggcagagagttggcctcattatgccagtatggctgccacagtgtcagacatcacattccaggcagtggaaaggagaaagaaccaaagggcatccctttctcttgaagcagtccctgtgaggggggattatctggaagccccaacccaatttctgcttccaaccattatccatagaaacaactggaagttgagaagtgcagtcttttaggtgggcacctggctgccctgtatgaaaccagaattaggttggtcagcaggaaaacaagaaaacacttactgtgttgactgaggtttttgacgcatcgctttattgtcaaattaaacaactctatctcattctgcactgaaacacgtactaccattgcctataattggaaaatgatcctcagaggcacagaagatgccctgatggaaagtttgccccttgggcaaagagacagccatgggaaccttcagacatagagagagaaggtggcttttctccctacattcctcaaatagctaagatttggccagtgtgttttctaagtcaattctagtgtgtttcatcctcacctcttccctctgtggctttgatgatggaagtgtagtcctaacctactgcacagctgggaccccctgcccctagatcccaatactggggatgggaggaccttgcactattcccctcagtccatctatcgaggtctttgcaggaagcatactgggaattgaaacgagagcctaaatgacatctaagaaaggcagtgttcaataccaggtattaggtgaggatgggattctaaggacatcagtgggaggcagggagccaccttcagacctcagcatggaagcttccaagatccagaggaagaggcaacagcactgagagtcataggtagaagaatcatcacagccctgctaaccaggcagctgatgcccctctcccctggctccctgtgtccaaatcctacaggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaaaagaaacatctatggagcatgggacacggggagtggaggcagctaaaagccatctcatctttcaccgtattcaacaagcccattataacaagtctttcacgctcaaccattcaaacaatcccaacaatcccagcctaagaatttcctggcatttgatgaaaatggctgtgggttttgctatctttaagctccctgggaagcaggatataagcccagggctggcaggctctttctagctacctgctcttgcacatagagtttgcctcatggttgcaagaaggctgccatagctccagatggcacatagacattccaggcagcaggaaaaaggaaggagcacttaaccgaaggaggtcagggagttggttagtctccacctgaagaagagagccatgaaccagcttcagttgactaacgggctcctgtgagtgcatctttggacttttctggaggttgaaatctagatgtggtatgtgtcttaaagcagccaccaactcctcccattaccttccaagtgagcccaactacacgatggagcctcttccctgcccttggatctgggctgagcctctgacttgcgttgaccaacagaatgcagtgaaagtgatgccgatactaccctccctgccctagacttgggatacctggcagctatattcttccattcctcaggacttgcaaaaacgggtctcagcatgccttcccagagccatgaggtgtttctttgcccattcattgatctgagaagtgagtgtaaggagtttaaatcaacctctgttctgtgctagttaaggtaataaagttgctgcagtccagggggtaggtacctgtggacggctctgcgaataggacagttgcatttcttgggaatcaagtgcatccctaggctggcagtgcagcagaaatactgaataaaatgtgacaaatctc

SEQ ID NO: 319138 - DNA, 5024 bp, Homo sapiens
  misc_feature (2056)..(2056): n is a, c, g, or t
  misc_feature (2061)..(2061): n is a, c, g, or t
  misc_feature (2192)..(2192): n is a, c, g, or t
  misc_feature (2195)..(2195): n is a, c, g, or t
  misc_feature (2264)..(2264): n is a, c, g, or t
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggaaaatggcaccagggtgtgaattgtgcatcccgcggggatcactgccaccaccccctgaaccacggatttgactatttctacggcatgcccttcacgctcacaaacgactgtgacccaggcaggccccccgaagtggacgccgccctgagggcgcagctctggggttacacccagttcctggcgctggggattctcaccctggctgccggccagacctgcggtttcttctctgtctccgcgagagcagtcaccggcatggccggcgtgggctgcctgtttttcatctcttggtactcctccttcgggtttgtgcgacgctggaactgtatcctgatgagaaaccatgacgtcacggagcaacccatggttctggagaaaacagcgagtcttatgctaaaggaagctgtttcctatattgaaagacacaagcatgggccatttctcctcttcctttctttgctgcatgtgcacattccccttgtgaccacgagtgcattcctggggaaaagtcagcatggcttatatggtgataatgtggaggagatggactggctcataggtaaggttcttaatgccatcgaagacaatggtttaaagaactcaacattcacgtatttcacctctgaccatggaggacatttagaggcaagagatggacacagccagttagggggatggaacggaatttacaaaggtgggaagggcatgggaggatgggaaggtgggatccgcgtgcccgggatcttccactggccgggggtgctcccggccggccgagtgattggagagcccacgagcctgatggacgtgttccctactgtggtccagctggtgggtggcgaggtgccccaggacagggtgattgatggccacagcctggtacccttgctgcagggagctgaggcacgctcggcacatgagttcctgtttcattactgtgggcagcatcttcacgcagcacgctggcaccagaaggacagtggaagcgtctggaaggttcattacacgaccccgcagttccaccccgagggagcgggggcctgctacggccgaggcgtctgcccatgctccggggagggcgtgacccatcacagaccccctttgctctttgacctctccagggacccctccgaggcacggcccctgacccccgactccgagcccctgtaccacgccgtgatagcaagggtaggtgccgcggtgtcggagcatcggcagaccctgagtcctgtgccccagcagttttccatgagcaacatcctgtggaagccgtggctgcagccgtgctgcggacatttcccgttctgttcatgccacgaggatggggatggcaccccctgaatgccaggactgtgagagaggatccaggagagcctgactgcgttgcaaacaaaattctccaagcttggttctatcttcagcttccctttttgcaaggaacatgccctggactgagagtgggtccccactttctttctttctttctttcttttttgagacagagtgtcgctctgtccctcaggctggantgcantggcacgatctctgctcactgcaacctccgcctcccgggttcaagcgattttcctgcctcagcctcctgagtacccaggattacaggcaccaggcacctgccaccatgcctagctaatttttgtagttttngtngagacagggtttcaccatgttgcccaggctggtctcgcactcctgacctcaagtcatccacctgcctcngcctcccaaagtgctgggattacaggcacgagccactgcgcccatgtagggtttccctttcctgatttgtgaaataagactgtcccagtaggcacccactgatgcctcctcttcctcttctaaatctcagggttcgtcattgtgccaatgcccgatgttttcacccctccgtcttaaagcattgttgcaatttcatcacctagatgacataacagccttacaaaaggacagggaggagtgtctgttcctactctcacatagcggaggaaagttagagcctctcagtctctgtttatgaggactcattaatctcaaataattgatgcatttttcatacattagggtctctgtccatgtgtcttcctgatattgttatagaaatggcttcaggctgctggtaacagatgctgcggaaaaagaatgccttaaacaaagccaggcacggtgactcacacctgtaatcccagcactttgggaggctgaggcgggaggattatttgagcctgggaggtcaaaactgcaatgagctaagattgcactactgcactccgggctgggagacagagtaagaccctgccttaaaaaaaaaaaaaaaaaaatgccttaaagaaaataataagagaagggtgtgttctcttccaagtaatgagccgatcaaggggaagcaacccaaggctagcaggctcttttcaattcccagctctgccactcttagcatggcagagagttggcctcattatgccagtatggctgccacagtgtcagacatcacattccaggcagtggaaaggagaaagaaccaaagggcatccctttctcttgaagcagtccctgtgaggggggattatctggaagccccaacccaatttctgcttccaaccattatccatagaaacaactggaagttgagaagtgcagtcttttaggtgggcacctggctgccctgtatgaaaccagaattaggttggtcagcaggaaaacaagaaaacacttactgtgttgactgaggtttttgacgcatcgctttattgtcaaattaaacaactctatctcattctgcactgaaacacgtactaccattgcctataattggaaaatgatcctcagaggcacagaagatgccctgatggaaagtttgccccttgggcaaagagacagccatgggaaccttcagacatagagagagaaggtggcttttctccctacattcctcaaatagctaagatttggccagtgtgttttctaagtcaattctagtgtgtttcatcctcacctcttccctctgtggctttgatgatggaagtgtagtcctaacctactgcacagctgggaccccctgcccctagatcccaatactggggatgggaggaccttgcactattcccctcagtccatctatcgaggtctttgcaggaagcatactgggaattgaaacgagagcctaaatgacatctaagaaaggcagtgttcaataccaggtattaggtgaggatgggattctaaggacatcagtgggaggcagggagccaccttcagacctcagcatggaagcttccaagatccagaggaagaggcaacagcactgagagtcataggtagaagaatcatcacagccctgctaaccaggcagctgatgcccctctcccctggctccctgtgtccaaatcctacaggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaaaagaaacatctatggagcatgggacacggggagtggaggcagctaaaagccatctcatctttcaccgtattcaacaagcccattataacaagtctttcacgctcaaccattcaaacaatcccaacaatcccagcctaagaatttcctggcatttgatgaaaatggctgtgggttttgctatctttaagctccctgggaagcaggatataagcccagggctggcaggctctttctagctacctgctcttgcacatagagtttgcctcatggttgcaagaaggctgccatagctccagatggcacatagacattccaggcagcaggaaaaaggaaggagcacttaaccgaaggaggtcagggagttggttagtctccacctgaagaagagagccatgaaccagcttcagttgactaacgggctcctgtgagtgcatctttggacttttctggaggttgaaatctagatgtggtatgtgtcttaaagcagccaccaactcctcccattaccttccaagtgagcccaactacacgatggagcctcttccctgcccttggatctgggctgagcctctgacttgcgttgaccaacagaatgcagtgaaagtgatgccgatactaccctccctgccctagacttgggatacctggcagctatattcttccattcctcaggacttgcaaaaacgggtctcagcatgccttcccagagccatgaggtgtttctttgcccattcattgatctgagaagtgagtgtaaggagtttaaatcaacctctgttctgtgctagttaaggtaataaagttgctgcagtccagggggtaggtacctgtggacggctctgcgaataggacagttgcatttcttgggaatcaagtgcatccctaggctggcagtgcagcagaaatactgaataaaatgtgacaaatctc

SEQ ID NO: 319139 - DNA, 4226 bp, Homo sapiens
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggaaaatggcaccagggtgtgaattgtgcatcccgcggggatcactgccaccaccccctgaaccacggatttgactatttctacggcatgcccttcacgctcacaaacgactgtgacccaggcaggccccccgaagtggacgccgccctgagggcgcagctctggggttacacccagttcctggcgctggggattctcaccctggctgccggccagacctgcggtttcttctctgtctccgcgagagcagtcaccggcatggccggcgtgggctgcctgtttttcatctcttggtactcctccttcgggtttgtgcgacgctggaactgtatcctgatgagaaaccatgacgtcacggagcaacccatggttctggagaaaacagcgagtcttatgctaaaggaagctgtttcctatattgaaagacacaagcatgggccatttctcctcttcctttctttgctgcatgtgcacattccccttgtgaccacgagtgcattcctggggaaaagtcagcatggcttatatggtgataatgtggaggagatggactggctcataggtaaggttcttaatgccatcgaagacaatggtttaaagaactcaacattcacgtatttcacctctgaccatggaggacatttagaggcaagagatggacacagccagttagggggatggaacggaatttacaaaggtgggaagggcatgggaggatgggaaggtgggatccgcgtgcccgggatcttccactggccgggggtgctcccggccggccgagtgattggagagcccacgagcctgatggacgtgttccctactgtggtccagctggtgggtggcgaggtgccccaggacagggtgattgatggccacagcctggtacccttgctgcagggagctgaggcacgctcggcacatgagttcctgtttcattactgtgggcagcatcttcacgcagcacgctggcaccagaaggacagtggaagcgtctggaaggttcattacacgaccccgcagttccaccccgagggagcgggggcctgctacggccgaggcgtctgcccatgctccggggagggcgtgacccatcacagaccccctttgctctttgacctctccagggacccctccgaggcacggcccctgacccccgactccgagcccctgtaccacgccgtgatagcaagggtaggtgccgcggtgtcggagcatcggcagaccctgagtcctgtgccccagcagttttccatgagcaacatcctgtggaagccgtggctgcagccgtgctgcggacatttcccgttctgttcatgccacgaggatggggatggcaccccctgaatgccaggactgtgagagaggatccaggagagcctgactgcgttgcaaacaaaattctccaagcttggttctatcttcagcttccctttttgcaaggaacatgccctggactgagagtgggtccccactttctttctttctttctttcttttttgagacagaagtaagaccctgccttaaaaaaaaaaaaaaaaaaatgccttaaagaaaataataagagaagggtgtgttctcttccaagtaatgagccgatcaaggggaagcaacccaaggctagcaggctcttttcaattcccagctctgccactcttagcatggcagagagttggcctcattatgccagtatggctgccacagtgtcagacatcacattccaggcagtggaaaggagaaagaaccaaagggcatccctttctcttgaagcagtccctgtgaggggggattatctggaagccccaacccaatttctgcttccaaccattatccatagaaacaactggaagttgagaagtgcagtcttttaggtgggcacctggctgccctgtatgaaaccagaattaggttggtcagcaggaaaacaagaaaacacttactgtgttgactgaggtttttgacgcatcgctttattgtcaaattaaacaactctatctcattctgcactgaaacacgtactaccattgcctataattggaaaatgatcctcagaggcacagaagatgccctgatggaaagtttgccccttgggcaaagagacagccatgggaaccttcagacatagagagagaaggtggcttttctccctacattcctcaaatagctaagatttggccagtgtgttttctaagtcaattctagtgtgtttcatcctcacctcttccctctgtggctttgatgatggaagtgtagtcctaacctactgcacagctgggaccccctgcccctagatcccaatactggggatgggaggaccttgcactattcccctcagtccatctatcgaggtctttgcaggaagcatactgggaattgaaacgagagcctaaatgacatctaagaaaggcagtgttcaataccaggtattaggtgaggatgggattctaaggacatcagtgggaggcagggagccaccttcagacctcagcatggaagcttccaagatccagaggaagaggcaacagcactgagagtcataggtagaagaatcatcacagccctgctaaccaggcagctgatgcccctctcccctggctccctgtgtccaaatcctacaggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaaaagaaacatctatggagcatgggacacggggagtggaggcagctaaaagccatctcatctttcaccgtattcaacaagcccattataacaagtctttcacgctcaaccattcaaacaatcccaacaatcccagcctaagaatttcctggcatttgatgaaaatggctgtgggttttgctatctttaagctccctgggaagcaggatataagcccagggctggcaggctctttctagctacctgctcttgcacatagagtttgcctcatggttgcaagaaggctgccatagctccagatggcacatagacattccaggcagcaggaaaaaggaaggagcacttaaccgaaggaggtcagggagttggttagtctccacctgaagaagagagccatgaaccagcttcagttgactaacgggctcctgtgagtgcatctttggacttttctggaggttgaaatctagatgtggtatgtgtcttaaagcagccaccaactcctcccattaccttccaagtgagcccaactacacgatggagcctcttccctgcccttggatctgggctgagcctctgacttgcgttgaccaacagaatgcagtgaaagtgatgccgatactaccctccctgccctagacttgggatacctggcagctatattcttccattcctcaggacttgcaaaaacgggtctcagcatgccttcccagagccatgaggtgtttctttgcccattcattgatctgagaagtgagtgtaaggagtttaaatcaacctctgttctgtgctagttaaggtaataaagttgctgcagtccagggggtaggtacctgtggacggctctgcgaataggacagttgcatttcttgggaatcaagtgcatccctaggctggcagtgcagcagaaatactgaataaaatgtgacaaatctc

SEQ ID NO: 319140 - DNA, 4801 bp, Homo sapiens
  misc_feature (2056)..(2056): n is a, c, g, or t
  misc_feature (2061)..(2061): n is a, c, g, or t
  misc_feature (2192)..(2192): n is a, c, g, or t
  misc_feature (2195)..(2195): n is a, c, g, or t
  misc_feature (2264)..(2264): n is a, c, g, or t
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggaaaatggcaccagggtgtgaattgtgcatcccgcggggatcactgccaccaccccctgaaccacggatttgactatttctacggcatgcccttcacgctcacaaacgactgtgacccaggcaggccccccgaagtggacgccgccctgagggcgcagctctggggttacacccagttcctggcgctggggattctcaccctggctgccggccagacctgcggtttcttctctgtctccgcgagagcagtcaccggcatggccggcgtgggctgcctgtttttcatctcttggtactcctccttcgggtttgtgcgacgctggaactgtatcctgatgagaaaccatgacgtcacggagcaacccatggttctggagaaaacagcgagtcttatgctaaaggaagctgtttcctatattgaaagacacaagcatgggccatttctcctcttcctttctttgctgcatgtgcacattccccttgtgaccacgagtgcattcctggggaaaagtcagcatggcttatatggtgataatgtggaggagatggactggctcataggtaaggttcttaatgccatcgaagacaatggtttaaagaactcaacattcacgtatttcacctctgaccatggaggacatttagaggcaagagatggacacagccagttagggggatggaacggaatttacaaaggtgggaagggcatgggaggatgggaaggtgggatccgcgtgcccgggatcttccactggccgggggtgctcccggccggccgagtgattggagagcccacgagcctgatggacgtgttccctactgtggtccagctggtgggtggcgaggtgccccaggacagggtgattgatggccacagcctggtacccttgctgcagggagctgaggcacgctcggcacatgagttcctgtttcattactgtgggcagcatcttcacgcagcacgctggcaccagaaggacagtggaagcgtctggaaggttcattacacgaccccgcagttccaccccgagggagcgggggcctgctacggccgaggcgtctgcccatgctccggggagggcgtgacccatcacagaccccctttgctctttgacctctccagggacccctccgaggcacggcccctgacccccgactccgagcccctgtaccacgccgtgatagcaagggtaggtgccgcggtgtcggagcatcggcagaccctgagtcctgtgccccagcagttttccatgagcaacatcctgtggaagccgtggctgcagccgtgctgcggacatttcccgttctgttcatgccacgaggatggggatggcaccccctgaatgccaggactgtgagagaggatccaggagagcctgactgcgttgcaaacaaaattctccaagcttggttctatcttcagcttccctttttgcaaggaacatgccctggactgagagtgggtccccactttctttctttctttctttcttttttgagacagagtgtcgctctgtccctcaggctggantgcantggcacgatctctgctcactgcaacctccgcctcccgggttcaagcgattttcctgcctcagcctcctgagtacccaggattacaggcaccaggcacctgccaccatgcctagctaatttttgtagttttngtngagacagggtttcaccatgttgcccaggctggtctcgcactcctgacctcaagtcatccacctgcctcngcctcccaaagtgctgggattacaggcacgagccactgcgcccatgtagggtttccctttcctgatttgtgaaataagactgtcccagtaggcacccactgatgcctcctcttcctcttctaaatctcagggttcgtcattgtgccaatgcccgatgttttcacccctccgtcttaaagcattgttgcaatttcatcacctagatgacataacagccttacaaaaggacagggaggagtgtctgttcctactctcacatagcggaggaaagttagagcctctcagtctctgtttatgaggactcattaatctcaaataattgatgcatttttcatacattagggtctctgtccatgtgtcttcctgatattgttatagaaatggcttcaggctgctggtaacagatgctgcggaaaaagaatgccttaaacaaagccaggcacggtgactcacacctgtaatcccagcactttgggaggctggggtgggaggatcacttgagcctaggagttagacacctacccagcctgagcaacacagtgagacctcatctctacaaaaaacaaataattagctagatgtcgtggcgcacagctgtggtctcagctacttaggaggctgaggcgggaggattatttgagcctgggaggtcaaaactgcaatgagctaagattgcactactgcactccgggctgggagacagagtaagaccctgccttaaaaaaaaaaaaaaaaaaatgccttaaagaaaataataagagaagggtgtgttctcttccaagtaatgagccgatcaaggggaagcaacccaaggctagcaggctcttttcaattcccagctctgccactcttagcatggcagagagttggcctcattatgccagtatggctgccacagtgtcagacatcacattccaggcagtggaaaggagaaagaaccaaagggcatccctttctcttgaagcagtccctgtgaggggggattatctggaagccccaacccaatttctgcttccaaccattatccatagaaacaactggaagttgagaagtgcagtcttttaggtgggcacctggctgccctgtatgaaaccagaattaggttggtcagcaggaaaacaagaaaacacttactgtgttgactgaggtttttgacgcatcgctttattgtcaaattaaacaactctatctcattctgcactgaaacacgtactaccattgcctataattggaaaatgatcctcagaggcacagaagatgccctgatggaaagtttgccccttgggcaaagagacagccatgggaaccttcagacctcagcatggaagcttccaagatccagaggaagaggcaacagcactgagagtcataggtagaagaatcatcacagccctgctaaccaggcagctgatgcccctctcccctggctccctgtgtccaaatcctacaggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaaaagaaacatctatggagcatgggacacggggagtggaggcagctaaaagccatctcatctttcaccgtattcaacaagcccattataacaagtctttcacgctcaaccattcaaacaatcccaacaatcccagcctaagaatttcctggcatttgatgaaaatggctgtgggttttgctatctttaagctccctgggaagcaggatataagcccagggctggcaggctctttctagctacctgctcttgcacatagagtttgcctcatggttgcaagaaggctgccatagctccagatggcacatagacattccaggcagcaggaaaaaggaaggagcacttaaccgaaggaggtcagggagttggttagtctccacctgaagaagagagccatgaaccagcttcagttgactaacgggctcctgtgagtgcatctttggacttttctggaggttgaaatctagatgtggtatgtgtcttaaagcagccaccaactcctcccattaccttccaagtgagcccaactacacgatggagcctcttccctgcccttggatctgggctgagcctctgacttgcgttgaccaacagaatgcagtgaaagtgatgccgatactaccctccctgccctagacttgggatacctggcagctatattcttccattcctcaggacttgcaaaaacgggtctcagcatgccttcccagagccatgaggtgtttctttgcccattcattgatctgagaagtgagtgtaaggagtttaaatcaacctctgttctgtgctagttaaggtaataaagttgctgcagtccagggggtaggtacctgtggacggctctgcgaataggacagttgcatttcttgggaatcaagtgcatccctaggctggcagtgcagcagaaatactgaataaaatgtgacaaatctc

SEQ ID NO: 319141 - DNA, 5185 bp, Homo sapiens
  misc_feature (2056)..(2056): n is a, c, g, or t
  misc_feature (2061)..(2061): n is a, c, g, or t
  misc_feature (2192)..(2192): n is a, c, g, or t
  misc_feature (2195)..(2195): n is a, c, g, or t
  misc_feature (2264)..(2264): n is a, c, g, or t
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggaaaatggcaccagggtgtgaattgtgcatcccgcggggatcactgccaccaccccctgaaccacggatttgactatttctacggcatgcccttcacgctcacaaacgactgtgacccaggcaggccccccgaagtggacgccgccctgagggcgcagctctggggttacacccagttcctggcgctggggattctcaccctggctgccggccagacctgcggtttcttctctgtctccgcgagagcagtcaccggcatggccggcgtgggctgcctgtttttcatctcttggtactcctccttcgggtttgtgcgacgctggaactgtatcctgatgagaaaccatgacgtcacggagcaacccatggttctggagaaaacagcgagtcttatgctaaaggaagctgtttcctatattgaaagacacaagcatgggccatttctcctcttcctttctttgctgcatgtgcacattccccttgtgaccacgagtgcattcctggggaaaagtcagcatggcttatatggtgataatgtggaggagatggactggctcataggtaaggttcttaatgccatcgaagacaatggtttaaagaactcaacattcacgtatttcacctctgaccatggaggacatttagaggcaagagatggacacagccagttagggggatggaacggaatttacaaaggtgggaagggcatgggaggatgggaaggtgggatccgcgtgcccgggatcttccactggccgggggtgctcccggccggccgagtgattggagagcccacgagcctgatggacgtgttccctactgtggtccagctggtgggtggcgaggtgccccaggacagggtgattgatggccacagcctggtacccttgctgcagggagctgaggcacgctcggcacatgagttcctgtttcattactgtgggcagcatcttcacgcagcacgctggcaccagaaggacagtggaagcgtctggaaggttcattacacgaccccgcagttccaccccgagggagcgggggcctgctacggccgaggcgtctgcccatgctccggggagggcgtgacccatcacagaccccctttgctctttgacctctccagggacccctccgaggcacggcccctgacccccgactccgagcccctgtaccacgccgtgatagcaagggtaggtgccgcggtgtcggagcatcggcagaccctgagtcctgtgccccagcagttttccatgagcaacatcctgtggaagccgtggctgcagccgtgctgcggacatttcccgttctgttcatgccacgaggatggggatggcaccccctgaatgccaggactgtgagagaggatccaggagagcctgactgcgttgcaaacaaaattctccaagcttggttctatcttcagcttccctttttgcaaggaacatgccctggactgagagtgggtccccactttctttctttctttctttcttttttgagacagagtgtcgctctgtccctcaggctggantgcantggcacgatctctgctcactgcaacctccgcctcccgggttcaagcgattttcctgcctcagcctcctgagtacccaggattacaggcaccaggcacctgccaccatgcctagctaatttttgtagttttngtngagacagggtttcaccatgttgcccaggctggtctcgcactcctgacctcaagtcatccacctgcctcngcctcccaaagtgctgggattacaggcacgagccactgcgcccatgtagggtttccctttcctgatttgtgaaataagactgtcccagtaggcacccactgatgcctcctcttcctcttctaaatctcagggttcgtcattgtgccaatgcccgatgttttcacccctccgtcttaaagcattgttgcaatttcatcacctagatgacataacagccttacaaaaggacagggaggagtgtctgttcctactctcacatagcggaggaaagttagagcctctcagtctctgtttatgaggactcattaatctcaaataattgatgcatttttcatacattagggtctctgtccatgtgtcttcctgatattgttatagaaatggcttcaggctgctggtaacagatgctgcggaaaaagaatgccttaaacaaagccaggcacggtgactcacacctgtaatcccagcactttgggaggctggggtgggaggatcacttgagcctaggagttagacacctacccagcctgagcaacacagtgagacctcatctctacaaaaaacaaataattagctagatgtcgtggcgcacagctgtggtctcagctacttaggaggctgaggcgggaggattatttgagcctgggaggtcaaaactgcaatgagctaagattgcactactgcactccgggctgggagacagagtaagaccctgccttaaaaaaaaaaaaaaaaaaatgccttaaagaaaataataagagaagggtgtgttctcttccaagtaatgagccgatcaaggggaagcaacccaaggctagcaggctcttttcaattcccagctctgccactcttagcatggcagagagttggcctcattatgccagtatggctgccacagtgtcagacatcacattccaggcagtggaaaggagaaagaaccaaagggcatccctttctcttgaagcagtccctgtgaggggggattatctggaagccccaacccaatttctgcttccaaccattatccatagaaacaactggaagttgagaagtgcagtcttttaggtgggcacctggctgccctgtatgaaaccagaattaggttggtcagcaggaaaacaagaaaacacttactgtgttgactgaggtttttgacgcatcgctttattgtcaaattaaacaactctatctcattctgcactgaaacacgtactaccattgcctataattggaaaatgatcctcagaggcacagaagatgccctgatggaaagtttgccccttgggcaaagagacagccatgggaaccttcagacatagagagagaaggtggcttttctccctacattcctcaaatagctaagatttggccagtgtgttttctaagtcaattctagtgtgtttcatcctcacctcttccctctgtggctttgatgatggaagtgtagtcctaacctactgcacagctgggaccccctgcccctagatcccaatactggggatgggaggaccttgcactattcccctcagtccatctatcgaggtctttgcaggaagcatactgggaattgaaacgagagcctaaatgacatctaagaaaggcagtgttcaataccaggtattaggtgaggatgggattctaaggacatcagtgggaggcagggagccaccttcagacctcagcatggaagcttccaagatccagaggaagaggcaacagcactgagagtcataggtagaagaatcatcacagccctgctaaccaggcagctgatgcccctctcccctggctccctgtgtccaaatcctacaggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaaaagaaacatctatggagcatgggacacggggagtggaggcagctaaaagccatctcatctttcaccgtattcaacaagcccattataacaagtctttcacgctcaaccattcaaacaatcccaacaatcccagcctaagaatttcctggcatttgatgaaaatggctgtgggttttgctatctttaagctccctgggaagcaggatataagcccagggctggcaggctctttctagctacctgctcttgcacatagagtttgcctcatggttgcaagaaggctgccatagctccagatggcacatagacattccaggcagcaggaaaaaggaaggagcacttaaccgaaggaggtcagggagttggttagtctccacctgaagaagagagccatgaaccagcttcagttgactaacgggctcctgtgagtgcatctttggacttttctggaggttgaaatctagatgtggtatgtgtcttaaagcagccaccaactcctcccattaccttccaagtgagcccaactacacgatggagcctcttccctgcccttggatctgggctgagcctctgacttgcgttgaccaacagaatgcagtgaaagtgatgccgatactaccctccctgccctagacttgggatacctggcagctatattcttccattcctcaggacttgcaaaaacgggtctcagcatgccttcccagagccatgaggtgtttctttgcccattcattgatctgagaagtgagtgtaaggagtttaaatcaacctctgttctgtgctagttaaggtaataaagttgctgcagtccagggggtaggtacctgtggacggctctgcgaataggacagttgcatttcttgggaatcaagtgcatccctaggctggcagtgcagcagaaatactgaataaaatgtgacaaatctcacaaatctccctggaaaaaaaa

SEQ ID NO: 319142 - DNA, 5135 bp, Homo sapiens
  misc_feature (2056)..(2056): n is a, c, g, or t
  misc_feature (2061)..(2061): n is a, c, g, or t
  misc_feature (2192)..(2192): n is a, c, g, or t
  misc_feature (2195)..(2195): n is a, c, g, or t
  misc_feature (2264)..(2264): n is a, c, g, or t
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggaaaatggcaccagggtgtgaattgtgcatcccgcggggatcactgccaccaccccctgaaccacggatttgactatttctacggcatgcccttcacgctcacaaacgactgtgacccaggcaggccccccgaagtggacgccgccctgagggcgcagctctggggttacacccagttcctggcgctggggattctcaccctggctgccggccagacctgcggtttcttctctgtctccgcgagagcagtcaccggcatggccggcgtgggctgcctgtttttcatctcttggtactcctccttcgggtttgtgcgacgctggaactgtatcctgatgagaaaccatgacgtcacggagcaacccatggttctggagaaaacagcgagtcttatgctaaaggaagctgtttcctatattgaaagacacaagcatgggccatttctcctcttcctttctttgctgcatgtgcacattccccttgtgaccacgagtgcattcctggggaaaagtcagcatggcttatatggtgataatgtggaggagatggactggctcataggtaaggttcttaatgccatcgaagacaatggtttaaagaactcaacattcacgtatttcacctctgaccatggaggacatttagaggcaagagatggacacagccagttagggggatggaacggaatttacaaaggtgggaagggcatgggaggatgggaaggtgggatccgcgtgcccgggatcttccactggccgggggtgctcccggccggccgagtgattggagagcccacgagcctgatggacgtgttccctactgtggtccagctggtgggtggcgaggtgccccaggacagggtgattgatggccacagcctggtacccttgctgcagggagctgaggcacgctcggcacatgagttcctgtttcattactgtgggcagcatcttcacgcagcacgctggcaccagaaggacagtggaagcgtctggaaggttcattacacgaccccgcagttccaccccgagggagcgggggcctgctacggccgaggcgtctgcccatgctccggggagggcgtgacccatcacagaccccctttgctctttgacctctccagggacccctccgaggcacggcccctgacccccgactccgagcccctgtaccacgccgtgatagcaagggtaggtgccgcggtgtcggagcatcggcagaccctgagtcctgtgccccagcagttttccatgagcaacatcctgtggaagccgtggctgcagccgtgctgcggacatttcccgttctgttcatgccacgaggatggggatggcaccccctgaatgccaggactgtgagagaggatccaggagagcctgactgcgttgcaaacaaaattctccaagcttggttctatcttcagcttccctttttgcaaggaacatgccctggactgagagtgggtccccactttctttctttctttctttcttttttgagacagagtgtcgctctgtccctcaggctggantgcantggcacgatctctgctcactgcaacctccgcctcccgggttcaagcgattttcctgcctcagcctcctgagtacccaggattacaggcaccaggcacctgccaccatgcctagctaatttttgtagttttngtngagacagggtttcaccatgttgcccaggctggtctcgcactcctgacctcaagtcatccacctgcctcngcctcccaaagtgctgggattacaggcacgagccactgcgcccatgtagggtttccctttcctgatttgtgaaataagactgtcccagtaggcacccactgatgcctcctcttcctcttctaaatctcagggttcgtcattgtgccaatgcccgatgttttcacccctccgtcttaaagcattgttgcaatttcatcacctagatgacataacagccttacaaaaggacagggaggagtgtctgttcctactctcacatagcggaggaaagttagagcctctcagtctctgtttatgaggactcattaatctcaaataattgatgcatttttcatacattagggtctctgtccatgtgtcttcctgatattgttatagaaatggcttcaggctgctggtaacagatgctgcggaaaaagaatgccttaaacaaagccaggcacggtgactcacacctgtaatcccagcactttgggaggctggggtgggaggatcacttgagcctaggagttagacacctacccagcctgagcaacacagtgagacctcatctctacaaaaaacaaataattagctagatgtcgtggcgcacagctgtggtctcagctacttaggaggctgaggcgggaggattatttgagcctgggaggtcaaaactgcaatgagctaagattgcactactgcactccgggctgggagacagagtaagaccctgccttaaaaaaaaaaaaaaaaaaatgccttaaagaaaataataagagaagggtgtgttctcttccaagtaatgagccgatcaaggggaagcaacccaaggctagcaggctcttttcaattcccagctctgccactcttagcatggcagagagttggcctcattatgccagtatggctgccacagtgtcagacatcacattccaggcagtggaaaggagaaagaaccaaagggcatccctttctcttgaagcagtccctgtgaggggggattatctggaagccccaacccaatttctgcttccaaccattatccatagaaacaactggaagttgagaagtgcagtcttttaggtgggcacctggctgccctgtatgaaaccagaattaggttggtcagcaggaaaacaagaaaacacttactgtgttgactgaggtttttgacgcatcgctttattgtcaaattaaacaactctatctcattctgcactgaaacacgtactaccattgcctataattggaaaatgatcctcagaggcacagaagatgccctgatggaaagtttgccccttgggcaaagagacagccatgggaaccttcagacatagagagagaaggtggcttttctccctacattcctcaaatagctaagatttggccagtgtgttttctaagtcaattctagtgtgtttcatcctcacctcttccctctgtggctttgatgatggaagtgtagtcctaacctactgcacagctgggaccccctgcccctagatcccaatactggggatgggaggaccttgcactattcccctcagtccatctatcgaggtctttgcaggaagcatactgggaattgaaacgagagcctaaatgacatctaagaaaggcagtgttcaataccaggtattaggtgaggatgggattctaaggacatcagtgggaggcagggagccaccttcagacctcagcatggaagcttccaagatccagaggaagaggcaacagcactgagagtcataggtagaagaatcatcacagccctgctaaccaggcagctgatgcccctctcccctggctccctgtgtccaaatcctacaggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaaaagaaacatctatggagcatgggacacggggagtggaggcagctaaaagccatctcatctttcaccgtattcaacaagcccattataacaagtctttcacgctcaaccattcaaacaatcccaacaatcccagcctaagaatttcctggcatttgatgaaaatggctgtgggttttgctatctttaagctccctgggaagcaggatataagcccagggctggcaggctctttctagctacctgctcttgcacatagagtttgcctcatggttgcaagaaggctgccatagctccagatggcacatagacattccaggcagcaggaaaaaggaaggagcacttaaccgaaggaggtcagggagttggttagtctccacctgaagaagagagccatgaaccagcttcagttgactaacgggctcctgtgagtgcatctttggacttttctggaggttgaaatctagatgtggtatgtgtcttaaagcagccaccaactcctcccattaccttccaagtcctgcccttggatctgggctgagcctctgacttgcgttgaccaacagaatgcagtgaaagtgatgccgatactaccctccctgccctagacttgggatacctggcagctatattcttccattcctcaggacttgcaaaaacgggtctcagcatgccttcccagagccatgaggtgtttctttgcccattcattgatctgagaagtgagtgtaaggagtttaaatcaacctctgttctgtgctagttaaggtaataaagttgctgcagtccagggggtaggtacctgtggacggctctgcgaataggacagttgcatttcttgggaatcaagtgcatccctaggctggcagtgcagcagaaatactgaataaaatgtgacaaatctc

SEQ ID NO: 319143 - DNA, 2802 bp, Homo sapiens
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggaaaatggcaccagggtgtgaattgtgcatcccgcggggatcactgccaccaccccctgaaccacggatttgactatttctacggcatgcccttcacgctcacaaacgactgtgacccaggcaggccccccgaagtggacgccgccctgagggcgcagctctggggttacacccagttcctggcgctggggattctcaccctggctgccggccagacctgcggtttcttctctgtctccgcgagagcagtcaccggcatggccggcgtgggctgcctgtttttcatctcttggtactcctccttcgggtttgtgcgacgctggaactgtatcctgatgagaaaccatgacgtcacggagcaacccatggttctggagaaaacagcgagtcttatgctaaaggaagctgtttcctatattgaaagacacaagcatgggccatttctcctcttcctttctttgctgcatgtgcacattccccttgtgaccacgagtgcattcctggggaaaagtcagcatggcttatatggtgataatgtggaggagatggactggctcataggtaaggttcttaatgccatcgaagacaatggtttaaagaactcaacattcacgtatttcacctctgaccatggaggacatttagaggcaagagatggacacagccagttagggggatggaacggaatttacaaaggtgggaagggcatgggaggatgggaaggtgggatccgcgtgcccgggatcttccactggccgggggtgctcccggccggccgagtgattggagagcccacgagcctgatggacgtgttccctactgtggtccagctggtgggtggcgaggtgccccaggacagggtgattgatggccacagcctggtacccttgctgcagggagctgaggcacgctcggcacatgagttcctgtttcattactgtgggcagcatcttcacgcagcacgctggcaccagaaggacagtggaagcgtctggaaggttcattacacgaccccgcagttccaccccgagggagcgggggcctgctacggccgaggcgtctgcccatgctccggggagggcgtgacccatcacagaccccctttgctctttgacctctccagggacccctccgaggcacggcccctgacccccgactccgagcccctgtaccacgccgtgatagcaagggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaaaagaaacatctatggagcatgggacacggggagtggaggcagctaaaagccatctcatctttcaccgtattcaacaagcccattataacaagtctttcacgctcaaccattcaaacaatcccaacaatcccagcctaagaatttcctggcatttgatgaaaatggctgtgggttttgctatctttaagctccctgggaagcaggatataagcccagggctggcaggctctttctagctacctgctcttgcacatagagtttgcctcatggttgcaagaaggctgccatagctccagatggcacatagacattccaggcagcaggaaaaaggaaggagcacttaaccgaaggaggtcagggagttggttagtctccacctgaagaagagagccatgaaccagcttcagttgactaacgggctcctgtgagtgcatctttggacttttctggaggttgaaatctagatgtggtatgtgtcttaaagcagccaccaactcctcccattaccttccaagtgagcccaactacacgatggagcctcttccctgcccttggatctgggctgagcctctgacttgcgttgaccaacagaatgcagtgaaagtgatgccgatactaccctccctgccctagacttgggatacctggcagctatattcttccattcctcaggacttgcaaaaacgggtctcagcatgccttcccagagccatgaggtgtttctttgcccattcattgatctgagaagtgagtgtaaggagtttaaatcaacctctgttctgtgctagttaaggtaataaagttgctgcagtccagggggtaggtacctgtggacggctctgcgaataggacagttgcatttcttgggaatcaagtgcatccctaggctggcagtgcagcagaaatactgaataaaatgtgacaaatctc

SEQ ID NO: 319144 - DNA, 1123 bp, Homo sapiens
cggcacgagggatgcccctgtaggatttggacacaggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaaaagaaacatctatggagcatgggacacggggagtggaggcagctaaaagccatctcatctttcaccgtattcaacaagcccattataacaagtctttcacgctcaaccattcaaacaatcccaacaatcccagcctaagaatttcctggcatttgatgaaaatggctgtgggttttgctatctttaagctccctgggaagcaggatataagcccagggctggcaggctctttctagctacctgctcttgcacatagagtttgcctcatggttgcaagaaggctgccatagctccagatggcacatagacattccaggcagcaggaaaaaggaaggagcacttaaccgaaggaggtcagggagttggttagtctccacctgaagaagagagccatgaaccagcttcagttgactaacgggctcctgtgagtgcatctttggacttttctggaggttgaaatctagatgtggtatgtgtcttaaagcagccaccaactcctcccattaccttccaagtgagcccaactacacgatggagcctcttccctgcccttggatctgggctgagcctctgacttgcgttgaccaacagaatgcagtgaaagtgatgccgatactaccctccctgccctagacttgggatacctggcagctatattcttccattcctcaggacttgcaaaaacgggtctcagcatgccttcccagagccatgaggtgtttctttgcccattcattgatctgagaagtgagtgtaaggagtttaaatcaacctctgttctgtgctagttaaggtaataaagttgctgcagtccagggggtaggtacctgtggacggctctgcgaataggacagttgcatttcttgggaatcaagtgcatccctaggctggcagtgcagcagaaatactgaataaaatgtgacaaatctc

SEQ ID NO: 319145 - DNA, 1244 bp, Homo sapiens
  misc_feature (60)..(60): n is a, c, g, or t
tacggcacctacatattagctagctttgctaacctcaaaatcagaccgagtgcgataaangcttctttaaaaggaatatacacatgtatttgtacacacacacacacagtgcagctgatgcccctctcccctggctccctgtgtccaaatcctacaggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaaaagaaacatctatggagcatgggacacggggagtggaggcagctaaaagccatctcatctttcaccgtattcaacaagcccattataacaagtctttcacgctcaaccattcaaacaatcccaacaatcccagcctaagaatttcctggcatttgatgaaaatggctgtgggttttgctatctttaagctccctgggaagcaggatataagcccagggctggcaggctctttctagctacctgctcttgcacatagagtttgcctcatggttgcaagaaggctgccatagctccagatggcacatagacattccaggcagcaggaaaaaggaaggagcacttaaccgaaggaggtcagggagttggttagtctccacctgaagaagagagccatgaaccagcttcagttgactaacgggctcctgtgagtgcatctttggacttttctggaggttgaaatctagatgtggtatgtgtcttaaagcagccaccaactcctcccattaccttccaagtgagcccaactacacgatggagcctcttccctgcccttggatctgggctgagcctctgacttgcgttgaccaacagaatgcagtgaaagtgatgccgatactaccctccctgccctagacttgggatacctggcagctatattcttccattcctcaggacttgcaaaaacgggtctcagcatgccttcccagagccatgaggtgtttctttgcccattcattgatctgagaagtgagtgtaaggagtttaaatcaacctctgttctgtgctagttaaggtaataaagttgctgcagtccagggggtaggtacctgtggacggctctgcgaataggacagttgcatttcttgggaatcaagtgcatccctaggctggcagtgcagcagaaatactgaataaaatgtgacaaatctc

SEQ ID NO: 319146 - DNA, 654 bp, Homo sapiens
cttgaaggccactcatactcatagtaagcagaatcttcaataatactagagcttaaatgggagagagtcatacagtagatgcttgaaaatgttcaaataaatgaaggccagggggctggatgcagtgactcacacctgtaatcctagcactttgggaggccaaagtgggaggatctcttgagcccaagagtttgagaccagccctggcaatcaagcttaagcttgattgcccttccaagtgagcccaactacacgatggagcctcttccctgcccttggatctgggctgagcctctgacttgcgttgaccaacagaatgcagtgaaagtgatgccgatactaccctccctgccctagacttgggatacctggcagctatattcttccattcctcaggacttgcaaaaacgggtctcagcatgccttcccagagccatgaggtgtttctttgcccattcattgatctgagaagtgagtgtaaggagtttaaatcaacctctgttctgtgctagttaaggtaataaagttgctgcagtccagggggtaggtacctgtggacggctctgcgaataggacagttgcatttcttgggaatcaagtgcatccctaggctggcagtgcagcagaaatactgaataaaatgtgacaaatctc

SEQ ID NO: 319147 - DNA, 766 bp, Homo sapiens
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggtgtggatatgtgggagcctcacattatacggtggttgggaatattcgtgataaaaaagatcccaggccaggcgtggtggcgcacgcctgtagtcccagctacttaggaggctgaggcaggagaatcgcttgaacccgggaagcggaggttgcagggagccgagatcacaccactgcactccagtctaggtgacaaagcgagactctgtctcaaagaaaaaaaaaacaaaaagatcccgtt

SEQ ID NO: 319148 - DNA, 4224 bp, Homo sapiens
  misc_feature (1117)..(1117): n is a, c, g, or t
  misc_feature (1122)..(1122): n is a, c, g, or t
  misc_feature (1253)..(1253): n is a, c, g, or t
  misc_feature (1256)..(1256): n is a, c, g, or t
  misc_feature (1325)..(1325): n is a, c, g, or t
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggagctgaggcacgctcggcacatgagttcctgtttcattactgtgggcagcatcttcacgcagcacgctggcaccagaaggacaaaaggtagtagatcgacgctgaacagtttcaacacaggggaaaggggaagaattaaggaacctctatgattctgatttctgaaagcagccacagtgagcgctctgcaatgagtccctttgcctggggcatgcaatgcagagacacaaacggacacacatgggcgcacgcgcgcacacacacatgctctgactttgcaagctgaaggctgtgattgtgtggactgcctcgtgtccctcctccttttcactgaatagggaggttcatgctgataccacagggccgacacctgcgttctgcgttcacacctgcgtggatttctgccaccctgactcccttcttgtctgcatccaggtggaagcgtctggaaggttcattacacgaccccgcagttccaccccgagggagcgggggcctgctacggccgaggcgtctgcccatgctccggggagggcgtgacccatcacagaccccctttgctctttgacctctccagggacccctccgaggcacggcccctgacccccgactccgagcccctgtaccacgccgtgatagcaagggtaggtgccgcggtgtcggagcatcggcagaccctgagtcctgtgccccagcagttttccatgagcaacatcctgtggaagccgtggctgcagccgtgctgcggacatttcccgttctgttcatgccacgaggatggggatggcaccccctgaatgccaggactgtgagagaggatccaggagagcctgactgcgttgcaaacaaaattctccaagcttggttctatcttcagcttccctttttgcaaggaacatgccctggactgagagtgggtccccactttctttctttctttctttcttttttgagacagagtgtcgctctgtccctcaggctggantgcantggcacgatctctgctcactgcaacctccgcctcccgggttcaagcgattttcctgcctcagcctcctgagtacccaggattacaggcaccaggcacctgccaccatgcctagctaatttttgtagttttngtngagacagggtttcaccatgttgcccaggctggtctcgcactcctgacctcaagtcatccacctgcctcngcctcccaaagtgctgggattacaggcacgagccactgcgcccatgtagggtttccctttcctgatttgtgaaataagactgtcccagtaggcacccactgatgcctcctcttcctcttctaaatctcagggttcgtcattgtgccaatgcccgatgttttcacccctccgtcttaaagcattgttgcaatttcatcacctagatgacataacagccttacaaaaggacagggaggagtgtctgttcctactctcacatagcggaggaaagttagagcctctcagtctctgtttatgaggactcattaatctcaaataattgatgcatttttcatacattagggtctctgtccatgtgtcttcctgatattgttatagaaatggcttcaggctgctggtaacagatgctgcggaaaaagaatgccttaaacaaagccaggcacggtgactcacacctgtaatcccagcactttgggaggctggggtgggaggatcacttgagcctaggagttagacacctacccagcctgagcaacacagtgagacctcatctctacaaaaaacaaataattagctagatgtcgtggcgcacagctgtggtctcagctacttaggaggctgaggcgggaggattatttgagcctgggaggtcaaaactgcaatgagctaagattgcactactgcactccgggctgggagacagagtaagaccctgccttaaaaaaaaaaaaaaaaaaatgccttaaagaaaataataagagaagggtgtgttctcttccaagtaatgagccgatcaaggggaagcaacccaaggctagcaggctcttttcaattcccagctctgccactcttagcatggcagagagttggcctcattatgccagtatggctgccacagtgtcagacatcacattccaggcagtggaaaggagaaagaaccaaagggcatccctttctcttgaagcagtccctgtgaggggggattatctggaagccccaacccaatttctgcttccaaccattatccatagaaacaactggaagttgagaagtgcagtcttttaggtgggcacctggctgccctgtatgaaaccagaattaggttggtcagcaggaaaacaagaaaacacttactgtgttgactgaggtttttgacgcatcgctttattgtcaaattaaacaactctatctcattctgcactgaaacacgtactaccattgcctataattggaaaatgatcctcagaggcacagaagatgccctgatggaaagtttgccccttgggcaaagagacagccatgggaaccttcagacatagagagagaaggtggcttttctccctacattcctcaaatagctaagatttggccagtgtgttttctaagtcaattctagtgtgtttcatcctcacctcttccctctgtggctttgatgatggaagtgtagtcctaacctactgcacagctgggaccccctgcccctagatcccaatactggggatgggaggaccttgcactattcccctcagtccatctatcgaggtctttgcaggaagcatactgggaattgaaacgagagcctaaatgacatctaagaaaggcagtgttcaataccaggtattaggtgaggatgggattctaaggacatcagtgggaggcagggagccaccttcagacctcagcatggaagcttccaagatccagaggaagaggcaacagcactgagagtcataggtagaagaatcatcacagccctgctaaccaggcagctgatgcccctctcccctggctccctgtgtccaaatcctacaggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaaaagaaacatctatggagcatgggacacggggagtggaggcagctaaaagccatctcatctttcaccgtattcaacaagcccattataacaagtctttcacgctcaaccattcaaacaatcccaacaatcccagcctaagaatttcctggcatttgatgaaaatggctgtgggttttgctatctttaagctccctgggaagcaggatataagcccagggctggcaggctctttctagctacctgctcttgcacatagagtttgcctcatggttgcaagaaggctgccatagctccagatggcacatagacattccaggcagcaggaaaaaggaaggagcacttaaccgaaggaggtcagggagttggttagtctccacctgaagaagagagccatgaaccagcttcagttgactaacgggctcctgtgagtgcatctttggacttttctggaggttgaaatctagatgtggtatgtgtcttaaagcagccaccaactcctcccattaccttccaagtgagcccaactacacgatggagcctcttccctgcccttggatctgggctgagcctctgacttgcgttgaccaacagaatgcagtgaaagtgatgccgatactaccctccctgccctagacttgggatacctggcagctatattcttccattcctcaggacttgcaaaaacgggtctcagcatgccttcccagagccatgaggtgtttctttgcccattcattgatctgagaagtgagtgtaaggagtttaaatcaacctctgttctgtgctagttaaggtaataaagttgctgcagtccagggggtaggtacctgtggacggctctgcgaataggacagttgcatttcttgggaatcaagtgcatccctaggctggcagtgcagcagaaatactgaataaaatgtgacaaatctc

SEQ ID NO: 319149 - DNA, 4959 bp, Homo sapiens
  misc_feature (2056)..(2056): n is a, c, g, or t
  misc_feature (2061)..(2061): n is a, c, g, or t
  misc_feature (2192)..(2192): n is a, c, g, or t
  misc_feature (2195)..(2195): n is a, c, g, or t
  misc_feature (2264)..(2264): n is a, c, g, or t
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggaaaatggcaccagggtgtgaattgtgcatcccgcggggatcactgccaccaccccctgaaccacggatttgactatttctacggcatgcccttcacgctcacaaacgactgtgacccaggcaggccccccgaagtggacgccgccctgagggcgcagctctggggttacacccagttcctggcgctggggattctcaccctggctgccggccagacctgcggtttcttctctgtctccgcgagagcagtcaccggcatggccggcgtgggctgcctgtttttcatctcttggtactcctccttcgggtttgtgcgacgctggaactgtatcctgatgagaaaccatgacgtcacggagcaacccatggttctggagaaaacagcgagtcttatgctaaaggaagctgtttcctatattgaaagacacaagcatgggccatttctcctcttcctttctttgctgcatgtgcacattccccttgtgaccacgagtgcattcctggggaaaagtcagcatggcttatatggtgataatgtggaggagatggactggctcataggtaaggttcttaatgccatcgaagacaatggtttaaagaactcaacattcacgtatttcacctctgaccatggaggacatttagaggcaagagatggacacagccagttagggggatggaacggaatttacaaaggtgggaagggcatgggaggatgggaaggtgggatccgcgtgcccgggatcttccactggccgggggtgctcccggccggccgagtgattggagagcccacgagcctgatggacgtgttccctactgtggtccagctggtgggtggcgaggtgccccaggacagggtgattgatggccacagcctggtacccttgctgcagggagctgaggcacgctcggcacatgagttcctgtttcattactgtgggcagcatcttcacgcagcacgctggcaccagaaggacagtggaagcgtctggaaggttcattacacgaccccgcagttccaccccgagggagcgggggcctgctacggccgaggcgtctgcccatgctccggggagggcgtgacccatcacagaccccctttgctctttgacctctccagggacccctccgaggcacggcccctgacccccgactccgagcccctgtaccacgccgtgatagcaagggtaggtgccgcggtgtcggagcatcggcagaccctgagtcctgtgccccagcagttttccatgagcaacatcctgtggaagccgtggctgcagccgtgctgcggacatttcccgttctgttcatgccacgaggatggggatggcaccccctgaatgccaggactgtgagagaggatccaggagagcctgactgcgttgcaaacaaaattctccaagcttggttctatcttcagcttccctttttgcaaggaacatgccctggactgagagtgggtccccactttctttctttctttctttcttttttgagacagagtgtcgctctgtccctcaggctggantgcantggcacgatctctgctcactgcaacctccgcctcccgggttcaagcgattttcctgcctcagcctcctgagtacccaggattacaggcaccaggcacctgccaccatgcctagctaatttttgtagttttngtngagacagggtttcaccatgttgcccaggctggtctcgcactcctgacctcaagtcatccacctgcctcngcctcccaaagtgctgggattacaggcacgagccactgcgcccatgtagggtttccctttcctgatttgtgaaataagactgtcccagtaggcacccactgatgcctcctcttcctcttctaaatctcagggttcgtcattgtgccaatgcccgatgttttcacccctccgtcttaaagcattgttgcaatttcatcacctagatgacataacagccttacaaaaggacagggaggagtgtctgttcctactctcacatagcggaggaaagttagagcctctcagtctctgtttatgaggactcattaatctcaaataattgatgcatttttcatacattagggtctctgtccatgtgtcttcctgatattgttatagaaatggcttcaggctgctggtaacagatgctgcggaaaaagaatgccttaaacaaagccaggcacggtgactcacacctgtaatcccagcactttgggaggctggggtgggaggatcacttgagcctaggagttagacacctacccagcctgagcaacacagtgagacctcatctctacaaaaaacaaataattagctagatgtcgtggcgcacagctgtggtctcagctacttaggaggctgaggcgggaggattatttgagcctgggaggtcaaaactgcaatgagctaagattgcactactgcactccgggctgggagacagagtaagaccctgccttaaaaaaaaaaaaaaaaaaatgccttaaagaaaataataagagaagggtgtgttctcttccaagtaatgagccgatcaaggggaagcaacccaaggctagcaggctcttttcaattcccagctctgccactcttagcatggcagagagttggcctcattatgccagtatggctgccacagtgtcagacatcacattccaggcagtggaaaggagaaagaaccaaagggcatccctttctcttgaagcagtccctgtgaggggggattatctggaagccccaacccaatttctgcttccaaccattatccatagaaacaactggaagttgagaagtgcagtcttttaggtgggcacctggctgccctgtatgaaaccagaattaggttggtcagcaggaaaacaagaaaacacttactgtgttgactgaggtttttgacgcatcgctttattgtcaaattaaacaactctatctcattctgcactgaaacacgtactaccattgcctataattggaaaatgatcctcagaggcacagaagatgccctgatggaaagtttgccccttgggcaaagagacagccatgggaaccttcagacatagagagagaaggtggcttttctccctacattcctcaaatagctaagatttggccagtgtgttttctaagtcaattctagtgtgtttcatcctcacctcttccctctgtggctttgatgatggaagtgtagtcctaacctactgcacagctgggaccccctgcccctagatcccaatactggggatgggaggaccttgcactattcccctcagtccatctatcgaggtctttgcaggaagcatactgggaattgaaacgagagcctaaatgacatctaagaaaggcagtgttcaataccaggtattaggtgaggatgggattctaaggacatcagtgggaggcagggagccaccttcagacctcagcatggaagcttccaagatccagaggaagaggcaacagcactgagagtcataggtagaagaatcatcacagccctgctaaccaggcagctgatgcccctctcccctggctccctgtgtccaaatcctacaggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaaaagaaacatctatggagcatgggacacggggagtggaggcagctaaaagccatctcatctttcaccgtattcaacaagcccattataacaagtctttcacgctcaaccattcaaacaatcccaacaatcccagcctaagaatttcctggcatttgatgaaaatggctgtgggttttgctatctttaagctccctgggaagcaggatataagcccagggctggcaggctctttctagctacctgctcttgcacatagagtttgcctcatggttgcaagaaggctgccatagctccagatggcacatagacattccaggcagcaggaaaaaggaaggagcacttaaccgaaggaggtcagggagttggttagtctccacctgaagaagagagccatgaaccagcttcagttgactaacgggctcctgtgagtgcatctttggacttttctggaggttgaaatctagatgtggtatgtgtcttaaagcagccaccaactcctcccattaccttccaagtgagcccaactacacgatggagcctcttccctgcccttggatctgggctgagcctctgacttgcgttgaccaacagaatgcagtgaaagtgatgccgatactaccctccctgccctagacttgggatacctttatagagctcaggtttctagggctggagagggatctggagggacacacaggagacacctggcataaccaaaaaatgatt

SEQ ID NO: 319150 - DNA, 4300 bp, Homo sapiens
  misc_feature (2056)..(2056): n is a, c, g, or t
  misc_feature (2061)..(2061): n is a, c, g, or t
  misc_feature (2192)..(2192): n is a, c, g, or t
  misc_feature (2195)..(2195): n is a, c, g, or t
  misc_feature (2264)..(2264): n is a, c, g, or t
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggaaaatggcaccagggtgtgaattgtgcatcccgcggggatcactgccaccaccccctgaaccacggatttgactatttctacggcatgcccttcacgctcacaaacgactgtgacccaggcaggccccccgaagtggacgccgccctgagggcgcagctctggggttacacccagttcctggcgctggggattctcaccctggctgccggccagacctgcggtttcttctctgtctccgcgagagcagtcaccggcatggccggcgtgggctgcctgtttttcatctcttggtactcctccttcgggtttgtgcgacgctggaactgtatcctgatgagaaaccatgacgtcacggagcaacccatggttctggagaaaacagcgagtcttatgctaaaggaagctgtttcctatattgaaagacacaagcatgggccatttctcctcttcctttctttgctgcatgtgcacattccccttgtgaccacgagtgcattcctggggaaaagtcagcatggcttatatggtgataatgtggaggagatggactggctcataggtaaggttcttaatgccatcgaagacaatggtttaaagaactcaacattcacgtatttcacctctgaccatggaggacatttagaggcaagagatggacacagccagttagggggatggaacggaatttacaaaggtgggaagggcatgggaggatgggaaggtgggatccgcgtgcccgggatcttccactggccgggggtgctcccggccggccgagtgattggagagcccacgagcctgatggacgtgttccctactgtggtccagctggtgggtggcgaggtgccccaggacagggtgattgatggccacagcctggtacccttgctgcagggagctgaggcacgctcggcacatgagttcctgtttcattactgtgggcagcatcttcacgcagcacgctggcaccagaaggacagtggaagcgtctggaaggttcattacacgaccccgcagttccaccccgagggagcgggggcctgctacggccgaggcgtctgcccatgctccggggagggcgtgacccatcacagaccccctttgctctttgacctctccagggacccctccgaggcacggcccctgacccccgactccgagcccctgtaccacgccgtgatagcaagggtaggtgccgcggtgtcggagcatcggcagaccctgagtcctgtgccccagcagttttccatgagcaacatcctgtggaagccgtggctgcagccgtgctgcggacatttcccgttctgttcatgccacgaggatggggatggcaccccctgaatgccaggactgtgagagaggatccaggagagcctgactgcgttgcaaacaaaattctccaagcttggttctatcttcagcttccctttttgcaaggaacatgccctggactgagagtgggtccccactttctttctttctttctttcttttttgagacagagtgtcgctctgtccctcaggctggantgcantggcacgatctctgctcactgcaacctccgcctcccgggttcaagcgattttcctgcctcagcctcctgagtacccaggattacaggcaccaggcacctgccaccatgcctagctaatttttgtagttttngtngagacagggtttcaccatgttgcccaggctggtctcgcactcctgacctcaagtcatccacctgcctcngcctcccaaagtgctgggattacaggcacgagccactgcgcccatgtagggtttccctttcctgatttgtgaaataagactgtcccagtaggcacccactgatgcctcctcttcctcttctaaatctcagggttcgtcattgtgccaatgcccgatgttttcacccctccgtcttaaagcattgttgcaatttcatcacctagatgacataacagccttacaaaaggacagggaggagtgtctgttcctactctcacatagcggaggaaagttagagcctctcagtctctgtttatgaggactcattaatctcaaataattgatgcatttttcatacattagggtctctgtccatgtgtcttcctgatattgttatagaaatggcttcaggctgctggtaacagatgctgcggaaaaagaatgccttaaacaaagccaggcacggtgactcacacctgtaatcccagcactttgggaggctggggtgggaggatcacttgagcctaggagttagacacctacccagcctgagcaacacagtgagacctcatctctacaaaaaacaaataattagctagatgtcgtggcgcacagctgtggtctcagctacttaggaggctgaggcgggaggattatttgagcctgggaggtcaaaactgcaatgagctaagattgcactactgcactccgggctgggagacagagtaagaccctgccttaaaaaaaaaaaaaaaaaaatgccttaaagaaaataataagagaagggtgtgttctcttccaagtaatgagccgatcaaggggaagcaacccaaggctagcaggctcttttcaattcccagctctgccactcttagcatggcagagagttggcctcattatgccagtatggctgccacagtgtcagacatcacattccaggcagtggaaaggagaaagaaccaaagggcatccctttctcttgaagcagtccctgtgaggggggattatctggaagccccaacccaatttctgcttccaaccattatccatagaaacaactggaagttgagaagtgcagtcttttaggtgggcacctggctgccctgtatgaaaccagaattaggttggtcagcaggaaaacaagaaaacacttactgtgttgactgaggtttttgacgcatcgctttattgtcaaattaaacaactctatctcattctgcactgaaacacgtactaccattgcctataattggaaaatgatcctcagaggcacagaagatgccctgatggaaagtttgccccttgggcaaagagacagccatgggaaccttcagacatagagagagaaggtggcttttctccctacattcctcaaatagctaagatttggccagtgtgttttctaagtcaattctagtgtgtttcatcctcacctcttccctctgtggctttgatgatggaagtgtagtcctaacctactgcacagctgggaccccctgcccctagatcccaatactggggatgggaggaccttgcactattcccctcagtccatctatcgaggtctttgcaggaagcatactgggaattgaaacgagagcctaaatgacatctaagaaaggcagtgttcaataccaggtattaggtgaggatgggattctaaggacatcagtgggaggcagggagccaccttcagacctcagcatggaagcttccaagatccagaggaagaggcaacagcactgagagtcataggtagaagaatcatcacagccctgctaaccaggcagctgatgcccctctcccctggctccctgtgtccaaatcctacaggggcatctgttggctgaactcaacctgaagcccacagggagatgacaggcaagacgcttacaataagacggcccaggcctagagggcatgagaggcagatcgagtggagagacaccgacacaccgggcggaaccacagcaatcgtacttgacatgaaaagacacaataaagacaacatcgtatcgagcagtgaacacagggagtggaggcacattgaaacatct

SEQ ID NO: 319151 - DNA, 2116 bp, Homo sapiens
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggaaaatggcaccagggtgtgaattgtgcatcccgcggggatcactgccaccaccccctgaaccacggatttgactatttctacggcatgcccttcacgctcacaaacgactgtgacccaggcaggccccccgaagtggacgccgccctgagggcgcagctctggggttacacccagttcctggcgctggggattctcaccctggctgccggccagacctgcggtttcttctctgtctccgcgagagcagtcaccggcatggccggcgtgggctgcctgtttttcatctcttggtactcctccttcgggtttgtgcgacgctggaactgtatcctgatgagaaaccatgacgtcacggagcaacccatggttctggagaaaacagcgagtcttatgctaaaggaagctgtttcctatattgaaagccagtgacttcatgtcatcatcagaagttaccgaaagtgaagcgataaagttaatgttcaggacaatgcagagacgctgtcttccttctatggccttcaagaaaccctggagaggaccagtgaggctgcagattcttaaaagagcatagacattaaaattcttgcagaatctgaatgtgtctcctgagacaagcatcgtgatagagttcacagtcttaaaagtctgcattttcaggtggggcaaggtggctcatgcctttaatcccagcattttgggaggctaaggcagggagatggcttgagaccaggagttcaagaccagcctgggcaacatagtgagacgcccccccccccatctctacaaaaaatttaaaaaattagccatggtggtgtgcacctgtggtcccagctactccagaggctgaggtgggaagatcatttgagcccaggaggctgaggctgcaatgactgataattattgcaccactgaactccagcctgggccacatagcaagaccctgtctccaaaaaaaaaaaaaaaaaaaaaaaggaataaaggacgcagaatagggagaaaaacttctctcatatcatttatttggtccttcagtatttctgaatacttagtctaatttggcacaaaatcaactgtattagtccattcttgcaaagaaatacctgagactgggtattttataaggaaaagaggttggattggctcacgttctgcagctgcacagaagcatggcagcatctgcttctgggagacctcggggagtttttgctcatggtggaaggcgaagggggagcaggcgtcttgcggcaggagaaggaccaagagaggagaggaagagccgcacacttttaaacaaccagatctcgtgagaagctactccctccgcagcaccaagcgggggatggtgctcaaccattcatgagaactctgtccccatcattcagtcacctccccccaggccccaccgccgattctgaggatgacaattccacatgagatttgggcggggacacacatccaaactatattgtcaaccttctacacagccaatgacttaacagcctcattagaagttacagaaactaaagcaataaagttcggacaatgcagagaggtcaccttccttctatggccttgaagaaaccctggag

SEQ ID NO: 319152 - DNA, 458 bp, Homo sapiens
tgtaaactagggcatgtactacactaaatgaagatcaccatgaattctacatgatcatctttatttttttctttacagtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 319153 - DNA, 364 bp, Homo sapiens
  misc_feature (8)..(8): n is a, c, g, or t
  misc_feature (113)..(114): n is a, c, g, or t
  misc_feature (333)..(333): n is a, c, g, or t
cggacctnatttccttctttatgccgtcctctctaggctgtctttggcgaggagggccccgcggaatcgtggtctatatccccgatacatattctgcctcactggtctacctnnttctcctgcaccctggttgcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccataangaaggaaatagagatcctctagaacagctat

SEQ ID NO: 319154 - DNA, 1180 bp, Homo sapiens
  misc_feature (49)..(49): n is a, c, g, or t
ctctatgaggaccccggtcaattgctacacccctaaggaagatgtattngtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 319155 - DNA, 1148 bp, Homo sapiens
tttggaatgtgcgatctcgtcactagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 319156 - DNA, 976 bp, Homo sapiens
tatagctgttctagaggatcccattaggcgcgttctgcgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 319157 - DNA, 951 bp, Homo sapiens
ccgcggcccgcggctctggcggctcggctggcttgggcaatgcctgcgggcagacggacgggcggacggcacattcggcacggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 319158 - DNA, 1593 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgtaaaaaaaaaaaaaaaaaaaaaaaaaaaaaaaaaaaaaattttttggggccgcgctctggaccctgaaaaacgtttctccaaccccattcgtgtgttgggcgccgcggggcggccgcatgtagtgagtatgtgcgacacttggtgtagacggtgtgggtccacaagggacaacccgcgggccagaagcctcaggtggctcgggtctctcccccaattgaaaaaacccgcggggggacacccgggtgtttttggaccaatccccagatgggggccgagcgggccataccggggcgctctcaacagggtgccaaggggcgagtataatacc

SEQ ID NO: 319159 - DNA, 1690 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgtaaaaaaaaaaaaaaaaaaaaaaaaaaaaaaaaaaaaaagagggggggcgcgccccaaaaaattttccccgcggggggccccaagtttagccgtgttccccagttttttttgttaacaagggggcccctatggggggtcgttttaaaagcgcagagggcccggggccgcgtgtgttaaaaacaaggcgccggacagaacggggagacaaccgtggctaaccgccgggggaacccttggggagaaagacgaaccctacccttccgtggggcgggcgagcccctacagtggcggacaaccatacccacacgagagaaattatacacagctctcaaagcgcacacttcatcacaacttcttccagcctggtctctacggggtcggcaacactaacggcgccgaaaatgactcaggcgcgtcacaaaaac

SEQ ID NO: 319160 - DNA, 1340 bp, Homo sapiens
  misc_feature (1278)..(1278): n is a, c, g, or t
  misc_feature (1293)..(1293): n is a, c, g, or t
  misc_feature (1340)..(1340): n is a, c, g, or t
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgttataaaaaaaaantcacttgccgcgttnacaacgtcggactggccctgcgtaacccttggccttgagcactcccn

SEQ ID NO: 319161 - DNA, 950 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagttattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 319162 - DNA, 833 bp, Homo sapiens
gaagcgtccggggaaactttgccccgtagcagacccgcttgaagcacagtcgccaacaacacccgtagcccagacgccggcaccagacacccactcggcccagccgccatcgcgtaccattttccgcaggtcaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 319163 - DNA, 1233 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcatcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 319164 - DNA, 1210 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcagaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 319165 - DNA, 1211 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 319166 - DNA, 701 bp, Homo sapiens
  misc_feature (8)..(8): n is a, c, g, or t
  misc_feature (113)..(114): n is a, c, g, or t
cggacctnatttccttctttatgccgtcctctctaggctgtctttggcgaggagggccccgcggaatcgtggtctatatccccgatacatattctgcctcactggtctacctnnttctcctgcaccctggttcagcaccctccatcacttctccctgcacaggagggttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 319167 - DNA, 759 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaactggtacgcggggggtcctctagagcgac

SEQ ID NO: 319168 - DNA, 810 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaaaaaaaaaaaaaaaaaaaaaaaaaaaaaaaaaaaaaagggggggcaagaaaaagaaaaaccccaaggggcgccaaagataagcgaacccaagatacggggacaagggggcccacaaaggggaacgaaaaaaaagc

SEQ ID NO: 319169 - DNA, 837 bp, Homo sapiens
  misc_feature (626)..(626): n is a, c, g, or t
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcagggccctnctcgccaaagacagcctagagaggacggcttattttccttctgtattgggtatacagtgaagtctgagtttcaaaagtgatttttttctcccacaaaagtttcaaacttaagctagaactttcagtgttaacttggccctaaaaagttaagacatattctgataatcatcacagtcacatgatttctgatgcagtctggtctgttaacaat

SEQ ID NO: 319170 - DNA, 594 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggcaccgggaggtagaggcacccgcgag

SEQ ID NO: 319171 - DNA, 487 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccacttcctggggttattcttctttatgg

SEQ ID NO: 319172 - DNA, 541 bp, Homo sapiens
  misc_feature (198)..(198): n is a, c, g, or t
gagctttcgggggacagcaggccccacactcacgctaaagaaggcgcacgtgcctctggtttttatagtggctggacagaggacaggtgcctccaggatgaaggatccctctcccacaggctggagtttgtgtggtttgaactgcccgtctgcaccaaggaagggagccccatgagctacctcaactttgcagagagncagccttgagtacttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaactgtacggagcgcaactgtacgcggggggttcctctagatgtcgccgcaccatcaactgcact

SEQ ID NO: 319173 - DNA, 1265 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 319174 - DNA, 1242 bp, Homo sapiens
ctgcagttagagggcaatctcttcagaacagtgaggaactgatatttagtcatttctgtgcacccctggtcacgcagttgcgcccccccccttttttttccttaactttgttgttttttgctttgtttgaaaatgttctgatttccttttgaaagtgttgaaagtgttctgatttcctttgtcactatcaatatgtaatggcttttgtagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 319175 - DNA, 1685 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgtaaaaaaaaaaaaaaaaaaaaaaaaaaaaaaaaaaaaaaaaaaaaaaggggggcacccataaaaaatatccccagagtgggccaaaaataaaagagtaaccagagattctgtgtacaaagaggggccaaaaaagagagcacattataaacacaagaatgtgcacagcaatatacaacatccggaagtcggcaacaacacgccacacagagagacacctgaggaacagcaaccctatcatcacacgtggagagggcaccaatcgtggcgacaacaaatccacaaagaaggatatgacacgccataagggacacacatcaaacttcaacgggtgatatacgtggtgacacacgcacggaaattatacatggcacatcgacaatttgagcccagcagatacgatttgcaacacttttaccgcgg

SEQ ID NO: 319176 - DNA, 1401 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgtaaaaaaaaaaaaaaaaaaaaaaaaaaaaaaaaaaaaaagggggggcaagaaaaagaaaaaccccaaggggcgccaaagataagcgaacccaagatacggggacaagggggcccacaaaggggaacgaaaaaaaagc

SEQ ID NO: 319177 - DNA, 1290 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgtcaacaccacaaacagcacaaaagag

SEQ ID NO: 319178 - DNA, 1318 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgatttcaaaagtcacaatgcagcctgtataaggtctatataaaaaaaaagggggggctcaaagtccgaggccagtaggtccgtttgcaaggcataggggtaaaagggcggaacggtggaagg

SEQ ID NO: 319179 - DNA, 712 bp, Homo sapiens
  misc_feature (21)..(21): n is a, c, g, or t
  misc_feature (32)..(32): n is a, c, g, or t
  misc_feature (43)..(43): n is a, c, g, or t
  misc_feature (47)..(47): n is a, c, g, or t
aaaaaaaaaaaaaagaaaaanaaaaaggaaanaaaaaaaaaanaaanaaaaaaaaaaaaatttctagggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 319180 - DNA, 804 bp, Homo sapiens
tctagatcctcgtacgagcgctcgtacgagcgcatcgtaacgagcgctcgtacgagcgtcgacagcgctcgtcgacctcgtaagactacatgtatgcaggtaaggtaattcactgtattcatgttctcccacttagaaacactgaaaatttaacgaaaaaaactataagcacatacatgaaagttggcgctcgttacgcgtacgagcgcaagaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 319181 - DNA, 1158 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 319182 - DNA, 832 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgatggcgagtgaaattacggcca

SEQ ID NO: 319183 - DNA, 787 bp, Homo sapiens
  misc_feature (626)..(626): n is a, c, g, or t
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcagggccctnctcgccaaagacagcctagagagtctcagttcgacggagactctcgacagcacatgaaaaaatctggtaggatgaaatgagtgtcagagcagggaatggaaaggagagtagaaactttatcaatgtgctgtcgagaggtctgaatccacactgattcttga

SEQ ID NO: 319184 - DNA, 572 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaacatatcgcggggacaccacctcttt

SEQ ID NO: 319185 - DNA, 697 bp, Homo sapiens
gtgtcccggcgcttatacggcgtcccccggggacaagaaggtatcgcaacgaaggttttgggaacagtaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacggggtaccgagctc

SEQ ID NO: 319186 - DNA, 241 bp, Homo sapiens
aagggtcctgctttccttctgccatgattgtaagtttcctgaagtctccccagccatgcggaactgggagtcaattaaacctttgtttataaattacctagtcttgggtagtatcttcatagcaatgtaaaaaccaattaatacacagggcaaatgtgattttcaattttcctttttattttttatttttgagatggagtcttgctctgtcacccaggctgtagtgcagtggtgtgatctt

SEQ ID NO: 319187 - DNA, 3775 bp, Homo sapiens
atgcgcagtgctcggattttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattcccttgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtacggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttaga

SEQ ID NO: 319188 - DNA, 1737 bp, Homo sapiens
atgcgcagtgctcggattttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaaatccgtaccacccaactctgctgtctccccatgagtttaagaaaatattttcttaaactcatggggagacagcagattcttgccttggtgaggtcattgctgtgccatatgtcctacccccctgtcttcagcaaatattttcttaaactcatggggagacagcagagttgggtggtacggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatgggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttaga

SEQ ID NO: 319189 - DNA, 3811 bp, Homo sapiens
atgcgcagtgctcggattttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcatctggaatcaagagacccatggcatctgaggtcttggaagctagacaggattcttacatctcattggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattcccttgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtacggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttaga

SEQ ID NO: 319190 - DNA, 3306 bp, Homo sapiens
gtttcaactttctgtgctgtggggtcagtggtaagagagcatctggaatcaagagacccatggcatctgaggtcttggaagctagacaggattcttacatctcattggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattcccttgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtacggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttaga

SEQ ID NO: 319191 - DNA, 2992 bp, Homo sapiens
tccaaaaaagaacactataatgaatatagaacccgttggttaaacaaagcaggctaggtacagagctacagcgaagtttcacggagaactatcagatacgatccacacagcgatacagatgaggtcttgctatgttacccaggctggtctcaaattcctgagctcaagtgatcctcctgtttggcctcccaaagtgctggggttacaggcatgagccactgcacctggctattttcgtcttctgttcttagttcagcttctagtttggggaatgagaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattcccttgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtacggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttaga

SEQ ID NO: 319192 - DNA, 1792 bp, Homo sapiens
aaaaatatttttggtacctcatacttggaggctgaggctgaaatagaaatttcttaacgcttgaattccatttctgcttaatctcatactccacatccttaactttacactctcccttttcagtaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtacggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttaga

SEQ ID NO: 319193 - DNA, 1809 bp, Homo sapiens
atgcgcagtgctcggattttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaaatccgtaccacccaactctgctgtctccccatgagtttaagaaaatattttcttaaactcatggggagacagcagattcttgccttggtgaggtcattgctgtgccatatgtcctacccccctgtcttcagcaaatattttcttaaactcatggggagacagcagagttgggtggtacggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttaga

SEQ ID NO: 319194 - DNA, 1738 bp, Homo sapiens
aaaaatatttttggtacctcatacttggaggctgaggctgaaatagaaatttcttaacgcttgaattccatttctgcttaatctcatactccacatccttaactttacactctcccttttcagtaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtacggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttaga

SEQ ID NO: 319195 - DNA, 958 bp, Homo sapiens
tctctgcccgttgctcacattatcacctgagctctgcctcctgtcagatcagcacagccattagattctcacaggagtgaaatatcctattgtgaactgcacgttcaagggatctaggtcacatgctccttattagactctaatgcctgatgatatgtcattgtctcctttctcttcactcgaaacccgggtttcgagtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttaga

SEQ ID NO: 319196 - DNA, 2035 bp, Homo sapiens
atgcgcagtgctcggattttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattccctgtaagtggtttctaccaattgactgcctactcctgcccagtggctcccttaccccaagagaacagagggcaggacacctctggtagggagctgccaatgccagaggcctctccttccacctacatcccatgagagccatttcttgtcctttgtgttagtctgtcatagtcatttccaagttgctgtttcccccttggctcttcctgcatatgtcaatgaggtgaggaccatttctggggaattgggatttgc

SEQ ID NO: 319197 - DNA, 1133 bp, Homo sapiens
atgcgcagtgctcggattttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgagtctcgctttgttgtccaagccgagattgggccactgctctccagtctgggcgagagagtgagaccctgtctc

SEQ ID NO: 319198 - DNA, 1551 bp, Homo sapiens
atgcgcagtgctcggattttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactcatcactcactcactcactcactcactcactca

SEQ ID NO: 319199 - DNA, 640 bp, Homo sapiens
aagagtgtcttagtgggcataaattaagatagcaaaagtactgaagaagttgagttaattaggagagcattcccaaaattgctgagtagtggcaattttagattctctttggtggaatcagagtggaagaggtaggcaagaagatttggagaaaactagattataatacatactgtagagagttcctggggttagaggaaggatctcattttctcctgtttttttaatgtatttttttctctttttgttttcttgatcacttattatctgaccttctggtttatggaggatgaggcagttatgtgtaggtttcacttccccatcctgatctgactaaactagccaacagattttctcaccctttcctttttgccttttccagtatgggtggcatccctgcccggaatagtaaaggggaaaggcttctgctttatattggcatcattgacattctacagtcttacaggtgaggagcatatggatcccaaattaagagagggtggatacagataatcagtcacgtttctcttttagataggtttgttaccaagttcttccggaagcaagaacagtgagttgcagtctggctacttacttcattagttttcagatggtttatttccttgattttgcctctttc

SEQ ID NO: 319200 - DNA, 652 bp, Homo sapiens
gtttcacttccccatcctgatctgactaaactagccaacagattttctcaccctttcctttttgccttttccagtatgggtggcatccctgcccggaatagtaaaggggaaaggcttctgctttatattggcatcattgacattctacagtcttacaggtgaggagcatatggatcccaaattaagagagggtggatacagataatcagtcacgtttctcttttagataggtttgttaccaagttcttccggaagcaagaacagtgagttgcagtctggctacttacttcattagttttcagatggtttatttccttgattttgcctctttccccggcctttataacccttcctcccccatctccccagacataatgtataccttctgtggaaagctgagtcagtccttggaagcaccagggtagaatatgccatctgtctggctctttgcaaaaacctatgagatgagtcatgttccacatggggatacaactggaaacgttacccttttccaaggaggaaaaacaggagggtcactgtgttctgtaaaatgtattagactgtggaactaagaggcaatggagtgatcatcagggaggagctggaattgttagaccccagttttgttcctgtaaggttttaaatactaatg

SEQ ID NO: 319201 - DNA, 331 bp, Homo sapiens
tcatctgtaggttttacccttctgctaggggctcagtctgggggaagatggcccttggactagagttcctcttgccgggcctcctaactctatagcatttcttctgctctgcaggacactgtctcagtgcatcgcccaggcttctacgctgaacggttccagcgcttcatgtgcaacacagtatttaagaagattccctgtaagtggtttctaccaattgactgcctactcctgcccagtggctcccttaccccaagagaacagagggcaggacacctctggtagggagctgccaatgccagaggcctctccttccacctacatcccatga

SEQ ID NO: 319202 - DNA, 370 bp, Homo sapiens
gcccggcagggcgtgggtagggagctggtgaggaatatgcgatgggaggaagagcgagacctaagagggtacctgtagctgggaatgtcctacgtgttaccggtaagtgggcgcgagctgggctttcaaatagggatttatgagcgggcaggagtttgaggaaaggataagtttgattaagaagttgtcgaaaactttggttgtctttgaggaggacggatggagattgaaggtgggggtagggtggcccggcgcggtggctcacgcctgtaatctcagcactttgggaggccttggcgggcggatcatttgaggtcagaagttcgagacgagcctggccaacatagagaaatctcgtccctactaaaaa

SEQ ID NO: 319203 - DNA, 3628 bp, Homo sapiens
atgcgcagtgctcggattttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattccctgcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtacggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttaga

SEQ ID NO: 319204 - DNA, 3934 bp, Homo sapiens
  misc_feature (6)..(6): n is a, c, g, or t
  misc_feature (18)..(18): n is a, c, g, or t
  misc_feature (46)..(46): n is a, c, g, or t
atgctncccggaaactanaggtaagggagaaaaaaagcactgtccnacctgtgcctgcctaacttctgggcaaggctggggaggctgtccttccagcagggtaaaacagtgtcagcacttctatcttaagagtgtagttcaggcccaggcgcggtggctcatgcttctaatcccagcaccttgggaggccgaggcgggcggatcacgaggtcaggagatcgagaccatcctggctaacacagtgaaaccccgtctctactaaaaatacaaaaaaattagctgggcatggtggcgggtgcctgtagtcccagctactcgggaggctgagacaggagaatggcgtgaacccgggaggcagagcttgcagtgagccgagatcgtgccactgcactccagcctgggcgatagagtgagactccatctcaaaaaaaaaagaaaaagttatatttcccagagaaaatatggatatttgaataagaaaggggtctagaataaaaatggaatatgcacgaggcctatgtgagtatggagaaggagagagggacatacacagttgctatccaaaaggatctggtattactgagcaagaggcaggagtttatacttatgtttagtttgactcaaactctgatggtttcagtatgcttgacagagatgtgagtgtgtgatacactcttatgattgtttttttttcccccctagccatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattcccttgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtacggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttaga

SEQ ID NO: 319205 - DNA, 3228 bp, Homo sapiens
ttgtattataatcttgactcttcttctaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattcccttgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtacggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttaga

SEQ ID NO: 319206 - DNA, 3647 bp, Homo sapiens
atgcgcagtgctcggattttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcatctggaatcaagagacccatggcatctgaggtcttggaagctagacaggattcttacatctcattggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattcccttgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtacggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccacccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttagaagacctcttattttttctgattctttttcatataccatctgctcaccctcctactccaccacccaggctcagttttgttcatgttgccctaaacaaaggctgcatactttcca

SEQ ID NO: 319207 - DNA, 1568 bp, Homo sapiens
atgcgcagtgctcggattttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgagtttgttacttagacatcaaaaatctcagttactaaaacagcttgattgttcttaggcattaagtttgtgggagatggaactctgttccttagcactgtatgtcctgggctgtatttaaaataagtcttaattagttcattgccattcctttacatttttactttctccccgtttatcctcccacaatgggatttatttccttct

SEQ ID NO: 319208 - DNA, 1155 bp, Homo sapiens
atgcgcagtgctcggattttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccaggtacagagtttaatgttcaggagcatgtcctggaaatgtggccttttcaaatcagcccagggcagttttaggggttcaggtcggacaatttagacatgtgtccatttcttaacctggttacaatcagggcgatgtgggactagagagttcggagagcagatactgtcctctagatgcttccattagcctctgtcctatggattgacccgtaaaaaacaacctaatgcattggataggaggcagtgtgatttcttcttcttcttatgtcttgctgtccatgctgtgccattgtctcactaactcatctaagaagggctgtgattatcttaggaggaatgtattcccccactccccccaccatgaggtg

SEQ ID NO: 319209 - DNA, 787 bp, Homo sapiens
atgcgcagtgctcggattttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcaggtaagcccggcagggcgtgggtagggagctggtgaggaatatgcgatgggaggaagagcgagacctaagagggtacctgtagctgggaatgtcctacgtgttaccggtaagtgggcgcgagctgggctttcaaatagggatttatgagcgggcaggagtttgaggaaaggataagtttgattaagaagttgtcgaaaactttggttgtctttgagaagtgcgcctagtgcgggatcctctaga

SEQ ID NO: 319210 - DNA, 595 bp, Homo sapiens
gctatctgaatcctaatagaaaaagctgaaaagcaatccactctgcactctagttcctcagaaattggtggcattaaatagaaagagactcagaaattggtggcattaaatagctctagaaatagagataagggctgggcgtggtggctcacgcctgtaaacccaacactttgggaggccaagagttcaagaccagcctgtccaacatggagaaaccccgtctctactaaaaatacaaaattagctgggcatggtggcgcacacctgtaacgcccagctacttgggaggctgaggcaggagaatcgcttgagccaggaggcagaggctgcggtgagctgagatcgtgccattgcactccagcagcctgggcaacaagagcaaaactccgaaaaaaaaaaaaaaaagaaagaggagagagagagagagagataaggtgagactgaaaagaagagcaccaactaaagtcatttaaagaagtgggtatctgggaagtggtaaaaaaataacataagataatataagataaaataaaataaaatagaggttagaaccccatatactgcccctacctatgccagaaccaaaaaaaaaaaa

SEQ ID NO: 319211 - DNA, 583 bp, Homo sapiens
tgacagatagggtcttgctctgttacccaggctggagcgcagtggcactatcatggctcactacaacctcgacctcctggctcatgtgacccttctacttcacactgcagcctcctgagtagctgggactacaggcacatgtcaacccacccagttaattttttaatttttttatagaaatagggtctcaccatgttgcccaggctggtctctactaaaaatacaaaattagctgggcatggtggcgcacacctgtaacgcccagctacttgggaggctgaggcaggagaatcgcttgagccaggaggcagaggctgcggtgagctgagatcgtgccattgcactccagcagcctgggcaacaagagcaaaactccgaaaaaaaaaaaaaaaagaaagaggagagagagagagagagataaggtgagactgaaaagaagagcaccaactaaagtcatttaaagaagtgggtatctgggaagtggtaaaaaaataacataagataatataagataaaataaaataaaatagaggttagaaccccatatactgcccctacctatgccagaaccaaaaaaaaaaaa

SEQ ID NO: 319212 - DNA, 620 bp, Homo sapiens
tgacagatagggtcttgctctgttacccaggctggagcgcagtggcactatcatggctcactacaacctcgacctcctggctcatgtgacccttctacttcacactgcagcctcctgagtagctgggactacaggcacatgtcaacccacccagttaattttttaatttttttatagaaatagggtctcaccatgttgcccaggctggtctcgaacccctgggctcaagtattccacctcagcctcccaaagtgtttggattacagccttgagccactgtgcacagccctatggcagctttttatccttcttataaactactgcttaagaaaaaaaaaagatatacaaagactaaacatagaaaatcttgttactaaagatttatagtgccatgaaaaatttccactagaaaactgaccatgtttttgattttttaccaaatataaatctttcttaatgctattatgatcctaaatactttaagcatgaaaactgacgatgtttttgatttcttaccaaatataaatctctcttaatgctatgatgatcctaaacattttaggctaggataatttttaaaaataaaatccagcattattattcataaaatgattcactgc

SEQ ID NO: 319213 - DNA, 283 bp, Homo sapiens
aagggccaaaggcctctgaatgtccctgtttatgaaatgaggacactctgacgcccacctacctgacacaaggagtcactgtcggtgttcccagagataggacccactgctgcccaaagctgaagcacccactctgggaacctggcgcagggctttacataaccaaatgccccagaaagagagtccgatggctttgcattcagaccaggaggctgagataggttatcaaggcccagctcctttgatgttgacagaggatcagaagccccttcccaggagctga

SEQ ID NO: 319214 - DNA, 1113 bp, Homo sapiens
ccagtatgtaatgtgtcaaaaaaactctaaaaggttagcttcatcgcgcaggaaggggcgtaggaaaatagagtaaagaacaaaggaggaaaacaacagcaagtcactgtaagtactgtgaaaataaactgaaagtagggctagaaaaaaaacagagaatgtccgagtagtctgatggaattgggagtctgagatgagaaggccacccaggtgagaccagggagattgaggccacaatgaatcacgattgcatctctctgctggaccttaatggtactgtaatggacaagagccatgtagctcttagatgtggcaaagtgagagccttctgttcgtccttagacttggcaagctgctggctaagtccagtgcttatggccgatattcgtctcaaaataaataaacaaaaaatacaagagtgaattcttaacaataacaaagaaataataacaatatgaaagatcaataaataagtgggaatgaagaaaggtaaaaggtaataccacaattaagaccttctctctctctctttctttctctctatttgtcacacctaggcttgagtgtgattaaaaaaaaaaaattaaaaggtaaacttcaccgtgcaggaagaagcataggaaaagagagagagaaaagaacaaagaaaaaaaagaatagcaagtctctccaagtactatggaaacaaacagaaagtggaattaggaaaaaagagaggaagaaggtctgagtagtccaagggacacgggaggccagttgggaagaccgcccgggcgagaccaggaagatcaaggccacagtgaatcacgatcccatccctctgctcaacctgaattgtactgctgctggcgagagagatctggtcgaccttagacatggcaaggcgagaggtgaggtccatcaggtcgaccttagtccaacgctcacagccgacatctctctcaaaataaataaacaaatccaacagtaaatatttaacaatgacaaaaaaattaaagaacaatacataaacaggttgcagttaacaaaagtaaaaagtaattaatatcacaattaagatcttctcccctgtctctctgtttgtcacacccaggctggagtgtgtgacaaaat

SEQ ID NO: 319215 - DNA, 212 bp, Homo sapiens
agctgaggcaggtcgtaaggtagtgaagacaggtctgtttgactcacatcaagggtatacaatctcttgctcaaccttaatgaatacaggtatttcaacattgttttacttcacagaaattatttacaactgatgttttatcaatcctaaaaaatagtgcaaatgtcactatgatatttgacaaaataaaggtattttatgaaatctccttt

SEQ ID NO: 319216 - DNA, 3559 bp, Homo sapiens
  misc_feature (824)..(824): n is a, c, g, or t
tgttgggtgggagcacaggcaccgggcaccatggggaaggccgagaactatgagctctactcggtggagctgggtcctggccctggcggggacatggctgccaagatgagcaagaagaagaaggcgggtggcgggggtggcaagaggaaggagaagctggagaacatgaagaaggagatggagattaacgaccaccagctgtcagtggcggagctggaacagaaataccagaccagtgccaccaagggcctctctgcgagcctggctgctgagctgctgctgcgggatgggcccaacgcactgcggccaccacggggcaccccagagtacgtcaagttcgcgaggcagctggccgggggcctgcagtgcctcatgtgggttgccgccgccatctgcctcatcgcctttgccatccaggctagtgagggggacctcaccaccgacgacaatctgtacctggcaatcgctctcattgctgtggttgtcgtcaccggctgctttggctactaccaggaattcaagagcaccaacatcatcgccagctttaagaaccttgtgccacagcaagccactgtcatccgcgatggagacaaattccagatcaacgctgaccaactggtggtgggcgacctggtggagatgaaaggtggggacagagtgcccgccgacatccgcatcctggcggcccagggctgcaaggtggacaactcctcgctgacaggggagtctgagccacagacccgctcacccgagtgcacgcacgagagccctctggagacccgcaacatcgccttcttctccaccatgtgccttgagggcaccgngcagggcctggtggtgaacacgggcgaccgcaccatcattgggcgcatcgcatcgctggcgtcgggggtggaaaacgagaagacacccatcgctatcgagatcgagcattttgtggacatcatcgcgggcctggccattctcttcggtgccacattttttattgtggccatgtgcattggctacaccttcctgcgggccatggtcttcttcatggccatcgtggtggcctatgtgcctgaggggctgctggccactgtcacagtctgcctgtccctgacagccaagcgcctggccagtaagaactgcgtggtcaagaacctggaggcggtggagacattgggctccacttcggtgatctgctcggacaagacagggactctcactcagaaccgcatgactgtgtcccatctgtggtttgacaaccacatccacacagctgacaccacggaagaccagtcagggcagacgtttgaccagtcctcggagacgtggcgggcgctgtgccgggtgctcaccctgtgcaaccgcgccgccttcaagtccggccaggatgcagtgcctgtgcccaagcgcatcgtgattggagacgcatcggagacggcgctgctcaagttctcggagctgacgctgggcaacgccatgggctaccgggaccgcttcccaaaagtctgcgagatacccttcaactccaccaacaagttccagctgtccatccatacgctggaggacccgcgggacccgcgacacttgctggtgatgaagggcgcccccgagcgcgtgctggagcgctgcagctccatccttatcaagggccaggagctgccgctggacgagcagtggcgcgaggccttccagaccgcctacctcagcctgggaggcctgggcgaacgcgtgctcggcttctgccagctctacctgaatgagaaggactacccgcctggctatgccttcgacgtagaggccatgaactttccatctagcggcctctgctttgcgggacttgtatccatgattgacccaccccgggccaccgtccctgatgctgtgctcaagtgtcgcaccgcaggcatccgggtgatcatggtaacgggtgaccaccccatcaccgccaaggccattgcagccagtgtgggcatcatctcggaaggcagcgagacagtggaggacatcgctgcccgcctccgtgtgcccgtagaccaggttaatcgcaaggatgcccgtgcctgtgtgatcaatggcatgcagctgaaggacatggacccatcggaactggtcgaggccctgcgcacccaccccgagatggtgtttgcgcgcaccagcccccagcagaagctggtgatcgtggagagctgccagcggctgggtgcgattgtggccgtcacgggggatggtgtgaatgactccccagctctgaagaaggcagacatcggagtagccatgggcatcgctggctcagatgctgccaaaaatgcagctgacatgatcctgctggatgacaactttgcctccattgtgacaggcgtggagcagggtcgactgatcttcgacaacctgaagaagtctattgcctacacattgaccaagaacatcccagagctgacaccctacctcatctacatcaccgtcagcgtgcccctgcccctcgggtgcatcaccatcctcttcatcgaactctgcactgacattttcccatctgtgtccctggcatatgaaaaggccgagagtgacatcatgcacctgcgtccacgcaacccaaagcgtgacagattggtcaacgagcccctggctgcctactcctacttccagattggtgccattcagtcctttgctggcttcactgactacttcacggcaatggcccaggagggctggttcccactgctgtgcgtggggctgcgggcgcagtgggaggaccaccacctacaagatctgcaggacagctacggccaggagtggacattcgggcagcgcctgtaccagcagtacacctgctacaccgtgttcttcatcagcattgaggtgtgccagatcgccgatgtcctcatccgcaagacgcgccgtctctctgccttccagcaaggcttcttcaggaataagatcctggtgatcgccatcgtgttccaggtctgcatcggctgcttcctgtgctactgccccggcatgcccaacatcttcaacttcatgcccattcggttccagtggtggctggtccccctgccctacggcatcctcatcttcgtctatgatgagatccggaagcttggagttcgctgttgcccagggagctggtgggaccaggaactctactattagagggacgactgccttcaagcatccctgcaactgccacagcaggtgggggcagggctcgtgggaccctctggacagccaccaagatatctgagcaaccaagagtcccagccccaccagtatctgcttctgtagcccacggcaccccaaacttggagggacctgcccactcccctcccccattcccaaggttcgcacctcctggagcagcagcgcctgggcagtcctctgggctggcctcgggaaagccgccacctgtggtggcggtggggctctgacagggagtacagctgaccgcttctggagggtgtttctgttcttaggactccagtccaggctggacggctgcctgagggcccttcgttaaagacacgcttgtgtcctgggcgatggtaataaaaccagctcatgctgactgtgctgt

SEQ ID NO: 319217 - DNA, 2971 bp, Homo sapiens
ctccacatttcccccatcacctccctgcctgtctatctgtccacttagctcccatccattctcctgccttcccatcatccactcattcagcaagtccttcccgaggcaaccctggggcaagtcctgtgccacacattgagggcgcagagatgacgaggccgggtccttaactggaagaggctgatgtcctgtgcaggcagccagcatgtcaccagaccttccacagtcagcacgattgtgtgaagagaattttcagaacctcggctgggacagctcagagaggggcctcgctactgtatctgggcagactggggaaggagtcccaaacaaagcactggctgaacaaaagctggggccaagaaaacacctggtgtttgcagaagcacgttgcacacgcagccccgcggctggggtaaagccttccccgttctttgacgcggggaagaggactggaagccagggtgggtccccagcctgcggtgctcaccccttccccaggtctgcctgtccctgacagccaagcgcctggccagtaagaactgcgtggtcaagaacctggaggcggtggagacattgggctccacttcggtgatctgctcggacaagacagggactctcactcagaaccgcatgactgtgtcccatctgtggtttgacaaccacatccacacagctgacaccacggaagaccagtcagggcagacgtttgaccagtcctcggagacgtggcgggcgctgtgccgggtgctcaccctgtgcaaccgcgccgccttcaagtccggccaggatgcagtgcctgtgcccaagcgcatcgtgattggagacgcatcggagacggcgctgctcaagttctcggagctgacgctgggcaacgccatgggctaccgggaccgcttcccaaaagtctgcgagatacccttcaactccaccaacaagttccagctgtccatccatacgctggaggacccgcgggacccgcgacacttgctggtgatgaagggcgcccccgagcgcgtgctggagcgctgcagctccatccttatcaagggccaggagctgccgctggacgagcagtggcgcgaggccttccagaccgcctacctcagcctgggaggcctgggcgaacgcgtgctcggcttctgccagctctacctgaatgagaaggactacccgcctggctatgccttcgacgtagaggccatgaactttccatctagcggcctctgctttgcgggacttgtatccatgattgacccaccccgggccaccgtccctgatgctgtgctcaagtgtcgcaccgcaggcatccgggtgatcatggtaacgggtgaccaccccatcaccgccaaggccattgcagccagtgtgggcatcatctcggaaggcagcgagacagtggaggacatcgctgcccgcctccgtgtgcccgtagaccaggttaatcgcaaggatgcccgtgcctgtgtgatcaatggcatgcagctgaaggacatggacccatcggaactggtcgaggccctgcgcacccaccccgagatggtgtttgcgcgcaccagcccccagcagaagctggtgatcgtggagagctgccagcggctgggtgcgattgtggccgtcacgggggatggtgtgaatgactccccagctctgaagaaggcagacatcggagtagccatgggcatcgctggctcagatgctgccaaaaatgcagctgacatgatcctgctggatgacaactttgcctccattgtgacaggcgtggagcagggtcgactgatcttcgacaacctgaagaagtctattgcctacacattgaccaagaacatcccagagctgacaccctacctcatctacatcaccgtcagcgtgcccctgcccctcgggtgcatcaccatcctcttcatcgaactctgcactgacattttcccatctgtgtccctggcatatgaaaaggccgagagtgacatcatgcacctgcgtccacgcaacccaaagcgtgacagattggtcaacgagcccctggctgcctactcctacttccagattggtgccattcagtcctttgctggcttcactgactacttcacggcaatggcccaggagggctggttcccactgctgtgcgtggggctgcgggcgcagtgggaggaccaccacctacaagatctgcaggacagctacggccaggagtggacattcgggcagcgcctgtaccagcagtacacctgctacaccgtgttcttcatcagcattgaggtgtgccagatcgccgatgtcctcatccgcaagacgcgccgtctctctgccttccagcaaggcttcttcaggaataagatcctggtgatcgccatcgtgttccaggtctgcatcggctgcttcctgtgctactgccccggcatgcccaacatcttcaacttcatgcccattcggttccagtggtggctggtccccctgccctacggcatcctcatcttcgtctatgatgagatccggaagcttggagttcgctgttgcccagggagctggtgggaccaggaactctactattagagggacgactgccttcaagcatccctgcaactgccacagcaggtgggggcagggctcgtgggaccctctggacagccaccaagatatctgagcaaccaagagtcccagccccaccagtatctgcttctgtagcccacggcaccccaaacttggagggacctgcccactcccctcccccattcccaaggttcgcacctcctggagcagcagcgcctgggcagtcctctgggctggcctcgggaaagccgccacctgtggtggcggtggggctctgacagggagtacagctgaccgcttctggagggtgtttctgttcttaggactccagtccaggctggacggctgcctgagggcccttcgttaaagacacgcttgtgtcctgggcgatggtaataaaaccagctcatgctgactgtgctgt

SEQ ID NO: 319218 - DNA, 1641 bp, Homo sapiens
tttttatttacaatggaaaatgttataattctggtccttttttaagtttgaacagaagggttgatcaaaatgtgttttgtctgttttaggcttgatgattcacgcttctctttaaactgccttaaagtaataaatactatggcattctgtttaatacacgaaaggtttccacttgatatacattgtgttaaaacagaagatagccatattcacatctgtttctgaaaccagactttgttaattaacagttttaaaatattaattagttttgacatcttgtaaattttaggtcaaaaatacagtccagaacttcctcaaagtgctaaccttaagtaacataacagtgtttgcctgtttgcttgcctggtaaattttgctttttatactgacagacattactaatgtttaagttgatttatcaacagtatttttaaaaactcaaatttgtcttgtgaaaaatgagatgattagaggaacagaaagaaagcaacaggtaaagaattcttcaatttacataaattacaaatgatttggtgctaaatttatgcactatgacatttggcttttatgcaatcatttttttttctttaaagatgttaacactacctgatattaatcataatgttccattatgttgattgcttgtaataggaagaaaaggggtgtcttcctgtgcaactgacacagctaggctttgacggcaggcctccacaaggtctacccttttgattccctttaactgaattctgttcatcaattgtttttgtttcatgggcggtgggaggggaaaggggaattcaatgcataaaataagtatttctaagggctcagtagaaatttctaccatagggatcatttcatgcatttattttttcatttagtctttgctgttatctgtccctcatcttcataactcagcagtggatttctcaagtttggagatgtaaggcaaaagtataattctttagaatgtttggattgtagtgatttatcattggctttcagatttgactgtcacttcagatttttgagcaaaaatactaaaaaaaaaaagaaaaaaaattctttgaagagacaggacctctgttgcccaggctggagtgcagtggtgtgattatagctcactgtaacctcaaactcctgggcttaagtgacatttctgcctcaactttctgagtagctagggctacaggtgcgtgtcaccatgcctcgctaacttaccaatttttttatagaagtggggtctccctgtgttgctcaggctgatcttgaactcctggccctcccgccttggcctccccaaaatgttgggattacaggcgagggccactttgcctggccccaaataacattttttcaaaggaatgtaaattttttttgttttagtttcataggcaaagtctttatgtctgggagagattggattttaggatattatagtaacagatgtattcctttgacctaacctgggcaaagcatttattgggctccctgcttcaacccccttggcagaaagatgaaatatgaattgtatcttcatcaagcttatgctacctttatacagttgtagaaaatacaggttagtaaatagtaattttaggtaacagtatcaaataggaagaagtaaataaaaaagaaagg

SEQ ID NO: 319219 - DNA, 155 bp, Homo sapiens
cctttccagctttgcgcagtggcagtatcgtagccaatgaggtttatccgaggcgcgattattgctaattgaaaacttttcccaataccccgccatgacgacttgaaatatagtcggcattggcaatttttgacgtcgacgcggccgcgaattta

SEQ ID NO: 319220 - DNA, 3158 bp, Homo sapiens
ggcagtttcacatacatgctctcatttaaccctcagtgagtgaattgtaatagttactcttattttatatgtgagggaaagaatctcaggaaggtttccatgcatactactcaaaattgaacatgcagtcaaatcacttgaggctgttggtaaaatgcagatcctgggtctgtaagtctaggctggggcctgagagttggcatttccaacaagctcctcagtgaccaatgcccctcctcacagaccacattctgggtggactagaagggcctggataaactacgaagctcacatggctggggagaagcagcctgactcagagcttctgttggctgccacttggcccccagcacaatactgcgcacggcacctttactgaagaggtgttcattgagtggctggtggctttccatggaaacagtttgaaatggattatcaacaaacacattttcagtcattgtcaacacatgtcaaaaccacatcatctgcaacaatttttgactcagtttatttacttttgctgtcaaacaagaaacggaagacgtgtcttcatatcactaagagtcccatttctccatctcctgcaattttggttttccaactctttgattcattgacaggacatttactgcccgcttgccatgtgttgggcattgcactaggcactggagttagaaaaatgaataaatctcagcagctgccctagagaatcatcgtgtctaatgggggagatatatgtgtataagactttcaaacttttttggcaacaacccactataagaatattttgcaatacagctggtgctcacattcctgctgctgtaactgaaacaaaatttcatgagtcaaatttaatagatgtgatatgagtggtattttctgttgtgtcctattaacatgttgttttaaaatattgattgtaacttgcagtttgaaaaaacacagcagatgaatcacaatggtaaatgctgtggtaaagacctaaagtcttcatatcaataaagtcacatttctctgtgggggattccaaagatggggcatcttgctttgtgatgtggaaggtgcaggactacaggcccagatggtgcacaagtagaaggcagaactataaaaggctctggatgattttctcctgaaagcatcagagacccaagaggaacttcatacatctctaggacagtaacatgattaattggagttccaacaaataattttaatcacagactatatcaacagggtatgctggtgatagggagattggttagaatgttcttctgaaattcccgtgccttttctaacacaggtattttctgtaatactgtgctacgaaacatgattttgcacttggtccaacctagattgcagtcctgctgtgttcttgctagttgtttgaacttgggacagtctgtatattggtgggacccgctgttgatgtctttgttttctagatgaaagaactagggcccagagaaggaagtggatttgagcaccatcagcacctagagtgtggtagagctggaaccagagcacaggcttcaaacttctcttccagtgtcctgtgtttgtgtgtgaggttgacagcaaataaccagttagttcaagctcttcgcgaggtagctccttttcatgtataaatgttactgggtttttctcttcttagctgtcaagttcaaaactcttctgttttttaaggaactcccaagttatttgaagcagctgcttttaaacctcaccattgccttgactttgcttaatgcagatcaaagacacagctctccccttctatcaagcgcaagagagaagtcagccctcctggggcccgaacaagaggccagcaaagggtggaggaagcccctgtgaaaaaagcgaagcgataatcctgaccactgctgccctaggcttatggaggaacacggtggagaggaaagagacatgccttggtggccataggcttctctttaaccaggaaaaagatatgcatgtgctgtaagtccctaggtgcaagctttttcttgttatgttttaaacagctttataaactattgttcatagaagatattatgtacatttatttcagataaaggacaataagtttactttgtatctgaactcaaaacaaagtagttgtatattttaacattcaaaattgggatttcccaatgtgacacatcatgaatgcaaacccctccagcccatcagacgccaggctgcctactggtaatctgtgtatagtatataaacatgtaaaaataggttgtattttactctatgtatgatgctaatcaatgaacactttatttattttacagagaaaacttatctgtgaactttactatatatctgtttattttactttattttttttttaaataaaaagggttttaaatgctatgcagtcattagtagaaaattttttaggactctgcctgctctgtaactatcttaatatgatctggcagaaactcgcatgtatccaagtaaagtagtttagctaaagaaaggttcttcattgcttttctgttcacagttgtggctctgttttttaagaatgtaacttgtttttagattatacttgcatctgtgactttactaccagccacgttgacacaaaacaggttctggttcaggtaaagttgcgtcagtcacctgcagcagaaatccctcttcattcctcttctctgtgttcattcctcttctgtgctgttctgaagcttctaccaatactctttccatattgtctttttcagtgaagagaaatgcattcaagattaggtccctcctgtctatccagtttcaggattttatgttgttttatacacagttatttcagtatagaaactggctttattgccaagtgtttttttaaacatgttttaactctcatatgagcaaactgtccaacttcagtttttcataagattaaacttcttacgatcaaatttgtctcttgcaatgatgtgatgagttgccaaataattgagattattttaaaatgttttgttcatattcttgttttataattaaaatttacattcagtgtgtatgggtttttttttttattttgactcttaatgtaaggtggatatttctgtcattttacatggtttcttactgagattttatatataaattataaaatgtttaccaaaaaaaaaaaa

SEQ ID NO: 319221 - DNA, 212 bp, Homo sapiens
cctataccacctttacatcattgattgcatttctatgtgatgattataaactgctgatttaaaatttttttttgtttgtttatttaaacataggtagaacaatctccatctagcagcaaactgaaagtaatgcaaacagatgaatccaataaagaaacagctaacctacaagaaagaagtataagcaatgtaagtgttaaatttcttatcaa

SEQ ID NO: 319222 - DNA, 7145 bp, Homo sapiens
  misc_feature (3895)..(3895): n is a, c, g, or t
gcggttcctcccttcagagaccaaaaaagagtggtgatatgacattgatccctgaacaagagccaatggaaattgattctgagccaggtgttgaaaatgtgtttgaagtatctaaaacccaagacaaccgcaataataattctcagcaagacattgactctgaaaatatgaaacaaaaaacttctgccactgttcaaaaggatgaattgagaacttgcacagcagattcaaaagcaacagctccagcttataagccaggccgtggaacaggagttaatagtaattctgaaaagcatgccgatcatagaagcaccttgaccaagaaaatgcatatacaaagtgctgtgtccaaaatgaaccctggggagaaagaacccattcatagaggaactactgaagtgaatatagattctgaaactgttcatagaatgttactgagtgccccatcagaaaatgatagggtacagaagaatttgaaaaacacagctgctgaagaacatgttgctcaaggagatgccactcttgaacattccacaaatttagactcctcaccatccttaagttcagtgactgttgtgcctctgagggaatcgtatgatccagatgtaattcctctgtttgacaaaagaactgttttggaaggtagcacagccagcacctcccctgcggatcactctgctctccctaaccaaagtctgactgttagggaatcagaagtccttaagacaagtgacagcaaagaaggtggtgaaggtttcacagtagatacaccagcaaaagcaagcatcactagcaaaagacacattccagaagctcaccaggctactttattggatggtaaacaaggaaaggtaatcatgcctcttggaagtaagttaacgggcgtgattgtggaaaatgagaatattaccaaagaaggtggcttagtggacatggccaagaaagaaaatgacttaaatgcagagcccaatttaaagcagacaattaaagcaacagtagagaatggcaagaaggatggcattgctgttgatcatgttgtaggcctgaatacagaaaaatatgctgaaactgtcaaacttaagcataaaagaagcccaggtaaagtaaaagacatatcaattgatgttgaaagaaggaatgaaaacagtgaggtagacaccagtgctggaagtggctctgcaccctctgttttacaccaaaggaacggacaaactgaggatgtggcaactgggcctaggagagcagaaaagacttctgttgccactagtactgaagggaaggacaaagatgtcaccttaagtccagtgaaggctgggcctgccacaaccacttcttcagaaacaagacaaagtgaggtggctttgccttgcaccagcattgaggcagatgaaggcctcataataggaacacattccagaaataatcctcttcatgttggtgcagaagccagtgaatgcactgtttttgctgcagctgaagaaggtggggctgttgtcacagagggatttgctgaaagtgaaaccttcctcacaagcactaaggaaggggaaagtggggagtgtgctgtggctgaatctgaggacagagcagcagacctactggctgtgcatgcagttaaaatcgaagccaatgtaaatagcgttgtgacagaggaaaaggatgatgctgtaaccagtgcaggctctgaagaaaaatgtgatggttctttaagtagagactcagaaatagttgaaggaactattacttttattagtgaagttgaaagtgatggagcagttacaagtgctggaacagagataagagcaggatctataagcagtgaagaggtggatggctcccagggaaatatgatgagaatgggtcccaaaaaagaaacagagggcactgtgacatgtacaggagcagaaggcagaagtgataactttgtgatctgctcagtaactggagcagggccccgggaggaacgcatggttacaggtgcaggtgttgtcctgggagataatgatgcaccaccaggaacaagtgccagccaagaaggagatggttctgtgaatgatggtacagaaggtgagagtgcagtcaccagcacggggataacagaagatggagaggggccagcaagttgcacaggttcagaagatagcagcgaaggctttgctataagttctgaatcggaagaaaatggagagagtgcaatggacagcacagtggccaaagaaggcactaatgtaccattagttgctgctggtccttgtgatgatgaaggcattgtgactagcacaggcgcaaaagaggaagacgaggaaggggaggatgttgtgactagtactggaagaggaaatgaaattgggcatgcttcaacttgtacagggttaggagaagaaagtgaaggggtcttgatttgtgaaagtgcagaaggggacagtcagattggtactgtggtagagcatgtggaagctgaggctggagctgccatcatgaatgcaaatgaaaataatgttgacagcatgagtggcacagagaaaggaagtaaagacacagatatctgctccagtgcaaaagggattgtagaaagcagtgtgaccagtgcagtctcaggaaaggatgaagtgacaccagttccaggaggttgtgagggtcctatgactagtgctgcatctgatcaaagtgacagtcagctcgaaaaagttgaagataccactatttccactggcctggtcgggggtagttacgatgttcttgtatctggtgaagtcccagaatgtgaagttgctcacacatcaccaagtgaaaaagaagatgaggacatcatcacctctgtagaaaatgaagagtgtgatggtctcatggcaactacagccagtggtgatattaccaaccagaatagcttagcagggggtaaaaatcaaggcaaagttttgattatttccaccagtaccacaaatgattacacccctcaggtaagcgcaattacagatgtggaaggaggtctctcagatgctctgagaactgaagaaaatatggaaggtaccagagtaaccacagaagaatttgaggcccccatgcccagtgcagtctcaggagatgacagccaactcactgccagcagaagtgaagagaaagatgagtgtgccatgatttccacaagcataggggaagaattcgaattgcctatctccagtgcaacaaccatcaagtgtgctgaaagtcttcagccggttgctgcagcagtggaagaaagggctacaggtccagtcttgataagcaccgccgactttgaggggcctatgcccagtgcgcccccagaagctgaaagtcctcttgcctcaaccagcaaggaggagaaggatgaatgtgctctcatttccactagcatagcagaagaatgtgaggcttctgtttccggtgtagttgttgaaagtgaaaatgagcgagctggcacagtcatggaagaaaaagacgggagtggcatcatctctacgagctcggtggaagactgtgagggcccagtgtccagtgctgtccctcaagaggaaggcgacccctcagtcacaccagcggaagagatgggtgacaccgccatgatttccacaagcacctctgaagggtgtgaagcagtcatgattggtgctgtcctccaggatgaagatcggctcaccatcacaagagtagaagacttgagcgatgctgccatcatctccaccagcacagcagaatgtatgccaatttccgccagcattgacagacatgaagagaatcagctgactgcagacaacccagaagggaacggtgacctgtcagccacagaagtgagcaagcacaaggtccccatgcccagcctaattgctgagaataactgtcggtgtcctgggccagtcaggggaggcaaagaacngggtcccgtgttggcagtgagcaccgaggaggggcacaacgggccatcagtccacaagccctctgcagggcaaggccatccaagtgctgtttgtgcggaaaaagaagagaagcatggcaaggagtgccccgaaataggaccatttgcaggaagaggacagaaagagagcactttacacctcataaatgcagaagagaagaatgtattgttgaactcccttcagaaagaagataagagcccagagacagggacagcagggggcagtagcacagcaagttattcagcaggaaggggcttagaggggaatgctaactcacctgcccacctgagaggaccagaacagacgtctgggcagacggctaaggatccctctgtcagcattcgctatttggcagcagtaaacaccggtgctataaaagctgatgacatgccacctgttcaagggaccgtggctgagcattcctttcttcctgctgagcagcaggggtctgaagacaacttgaaaaccagtaccaccaaatgtattactggccaagaatcaaaaattgctccttcccacacaatgatccctccagctacttacagtgtagctctgttggctcctaaatgtgagcaggacttgactataaagaatgattatagtggcaaatggactgatcaagcatctgctgagaaaacaggagatgataacagcacaaggaaatcattccctgaggaaggagacataatggttactgtgtcttctgaagaaaatgtgtgtgacataggcaatgaagagtctccattgaatgttttgggaggattgaaactgaaagccaacttgaaaatggaggcttatgtgccttcagaggaagagaaaaatggtgaaattctggcaccaccagaaagtctgtgtgggggaaagccaagtggaatagctgaactccagagggagcctttgttggtgaatgaatcactaaatgttgaaaattcaggcttcagaacaaatgaagaaattcatagcgaatcttataacaaaggagagatatccagtggtagaaaagacaacgcagaagccataagcggtcacagtgttgaagcagatcctaaagaggttgaagaggaagaaaggcatatgcctaaaagaaaaagaaagcagcattatctctcttcagaagatgaaccagatgataatccagatgtcctggattccagaatagaaacagcacaaaggcagtgtcctgaaacggagccacatgacacaaaggaagagaactccagagatttggaagaattacctaaaaccagttctgagacaaatagcactacctcaagggtcatggaagaaaaagatgaatatagcagcagtgaaactactggtgaaaagccagagcagaacgatgatgacaccataaaatctcaggaggaagatcagccaataattattaaaaggaaaagaggaagacctcgcaaataccctgtagaaacaacgttaaaaatgaaagacgactccaaaacagatactggcattgtcactgtagaacaatctccatctagcagcaaactgaaagtaatgcaaacagatgaatccaataaagaaacagctaacctacaagaaagaagtataagcaatgatgatggtgaagaaaaaatagtaacaagtgtgcgtcggagaggaagaaaacccaaacgttctctcactgtatcagatgatgctgaatcctcagagccagaaagaaaacgccagaaatcagtttctgatccagtggaggacaagaaagagcaggagtctgatgaggaagaggaagaagaggaagaggacgagccttcaggagccaccacaagatccaccaccagatcagaggctcagagatcaaagacacagctctccccttctatcaagcgcaagagagaagtcagccctcctggggcccgaacaagaggccagcaaagggtggaggaagcccctgtgaaaaaagcgaagcgataatcctgaccactgctgccctaggcttatggaggaacacggtggagaggaaagagacatgccttggtggccataggcttctctttaaccaggaaaaagatatgcatgtgctgtaagtccctaggtgcaagctttttcttgttatgttttaaacagctttataaactattgttcatagaagatattatgtacatttatttcagataaaggacaataagtttactttgtatctgaactcaaaacaaagtagttgtatattttaacattcaaaattgggatttcccaatgtgacacatcatgaatgcaaacccctccagcccatcagacgccaggctgcctactggtaatctgtgtatagtatataaacatgtaaaaataggttgtattttactctatgtatgatgctaatcaatgaacactttatttattttacagagaaaacttatctgtgaactttactatatatctgtttattttactttattttttttttaaataaaaagggttttaaatgctatgcagtcattagtagaaaattttttaggactctgcctgctctgtaactatcttaatatgatctggcagaaactcgcatgtatccaagtaaagtagtttagctaaagaaaggttcttcattgcttttctgttcacagttgtggctctgttttttaagaatgtaacttgtttttagattatacttgcatctgtgactttactaccagccacgttgacacaaaacaggttctggttcaggtaaagttgcgtcagtcacctgcagcagaaatccctcttcattcctcttctctgtgttcattcctcttctgtgctgttctgaagcttctaccaatactctttccatattgtctttttcagtgaagagaaatgcattcaagattaggtccctcctgtctatccagtttcaggattttatgttgttttatacacagttatttcagtatagaaactggctttattgccaagtgtttttttaaacatgttttaactctcatatgagcaaactgtccaacttcagtttttcataagattaaacttcttacgatcaaatttgtctcttgcaatgatgtgatgagttgccaaataattgagattattttaaaatgttttgttcatattcttgttttataattaaaatttacattcagtgtgtatgggtttttttttttattttgactcttaatgtaaggtggatatttctgtcattttacatggtttcttactgagattttatatataaattataaaatgtttaccaaaaaaaaaaaa

SEQ ID NO: 319223 - DNA, 6484 bp, Homo sapiens
  misc_feature (3234)..(3234): n is a, c, g, or t
gcggttcctcccttcagagaccaaaaaagagtggtgatatgacattgatccctgaacaagagccaatggaaattgattctgagccaggtgttgaaaatgtgtttgaagtatctaaaacccaagacaaccgcaataataattctcagcaagacattgactctgaaaatatgaaacaaaaaacttctgccactgttcaaaaggatgaattgagaacttgcacagcagattcaaaagcaacagctccagcttataagccaggccgtggaacaggagttaatagtaattctgaaaagcatgccgatcatagaagcaccttgaccaagaaaatgcatatacaaagtgctgtgtccaaaatgaaccctggggagaaagaacccattcatagaggaactactgaagtgaatatagattctgaaactgttcatagaatgttactgagtgccccatcagaaaatgatagggtacagaagaatttgaaaaacacagctgctgaagaacatgttgctcaaggagatgccactcttgaacattccacaaatttagactcctcaccatccttaagttcagtgactgttgtgcctctgagggaatcgtatgatccagatgtaattcctctgtttgacaaaagaactgttttggaaggtagcacagccagcacctcccctgcggatcactctgctctccctaaccaaagtctgactgttagggaatcagaagtccttaagacaagtgacagcaaagaaggtggtgaaggtttcacagtagatacaccagcaaaagcaagcatcactagcaaaagacacattccagaagctcaccaggctactttattggatggtaaacaaggaaaggtaatcatgcctcttggaagtaagttaacgggcgtgattgtggaaaatgagaatattaccaaagaaggtggcttagtggacatggccaagaaagaaaatgacttaaatgcagagcccaatttaaagcagacaattaaagcaacagtagagaatggcaagaaggatggcattgctgttgatcatgttgtaggcctgaatacagaaaaatatgctgaaactgtcaaacttaagcataaaagaagcccaggtaaagtaaaagacatatcaattgatgttgaaagaaggaatgaaaacagtgaggtagacaccagtgctggaagtggctctgcaccctctgttttacaccaaaggaacggacaaactgaggatgtggcaactgggcctaggagacagaaggcagaagtgataactttgtgatctgctcagtaactggagcagggccccgggaggaacgcatggttacaggtgcaggtgttgtcctgggagataatgatgcaccaccaggaacaagtgccagccaagaaggagatggttctgtgaatgatggtacagaaggtgagagtgcagtcaccagcacggggataacagaagatggagaggggccagcaagttgcacaggttcagaagatagcagcgaaggctttgctataagttctgaatcggaagaaaatggagagagtgcaatggacagcacagtggccaaagaaggcactaatgtaccattagttgctgctggtccttgtgatgatgaaggcattgtgactagcacaggcgcaaaagaggaagacgaggaaggggaggatgttgtgactagtactggaagaggaaatgaaattgggcatgcttcaacttgtacagggttaggagaagaaagtgaaggggtcttgatttgtgaaagtgcagaaggggacagtcagattggtactgtggtagagcatgtggaagctgaggctggagctgccatcatgaatgcaaatgaaaataatgttgacagcatgagtggcacagagaaaggaagtaaagacacagatatctgctccagtgcaaaagggattgtagaaagcagtgtgaccagtgcagtctcaggaaaggatgaagtgacaccagttccaggaggttgtgagggtcctatgactagtgctgcatctgatcaaagtgacagtcagctcgaaaaagttgaagataccactatttccactggcctggtcgggggtagttacgatgttcttgtatctggtgaagtcccagaatgtgaagttgctcacacatcaccaagtgaaaaagaagatgaggacatcatcacctctgtagaaaatgaagagtgtgatggtctcatggcaactacagccagtggtgatattaccaaccagaatagcttagcagggggtaaaaatcaaggcaaagttttgattatttccaccagtaccacaaatgattacacccctcaggtaagcgcaattacagatgtggaaggaggtctctcagatgctctgagaactgaagaaaatatggaaggtaccagagtaaccacagaagaatttgaggcccccatgcccagtgcagtctcaggagatgacagccaactcactgccagcagaagtgaagagaaagatgagtgtgccatgatttccacaagcataggggaagaattcgaattgcctatctccagtgcaacaaccatcaagtgtgctgaaagtcttcagccggttgctgcagcagtggaagaaagggctacaggtccagtcttgataagcaccgccgactttgaggggcctatgcccagtgcgcccccagaagctgaaagtcctcttgcctcaaccagcaaggaggagaaggatgaatgtgctctcatttccactagcatagcagaagaatgtgaggcttctgtttccggtgtagttgttgaaagtgaaaatgagcgagctggcacagtcatggaagaaaaagacgggagtggcatcatctctacgagctcggtggaagactgtgagggcccagtgtccagtgctgtccctcaagaggaaggcgacccctcagtcacaccagcggaagagatgggtgacaccgccatgatttccacaagcacctctgaagggtgtgaagcagtcatgattggtgctgtcctccaggatgaagatcggctcaccatcacaagagtagaagacttgagcgatgctgccatcatctccaccagcacagcagaatgtatgccaatttccgccagcattgacagacatgaagagaatcagctgactgcagacaacccagaagggaacggtgacctgtcagccacagaagtgagcaagcacaaggtccccatgcccagcctaattgctgagaataactgtcggtgtcctgggccagtcaggggaggcaaagaacngggtcccgtgttggcagtgagcaccgaggaggggcacaacgggccatcagtccacaagccctctgcagggcaaggccatccaagtgctgtttgtgcggaaaaagaagagaagcatggcaaggagtgccccgaaataggaccatttgcaggaagaggacagaaagagagcactttacacctcataaatgcagaagagaagaatgtattgttgaactcccttcagaaagaagataagagcccagagacagggacagcagggggcagtagcacagcaagttattcagcaggaaggggcttagaggggaatgctaactcacctgcccacctgagaggaccagaacagacgtctgggcagacggctaaggatccctctgtcagcattcgctatttggcagcagtaaacaccggtgctataaaagctgatgacatgccacctgttcaagggaccgtggctgagcattcctttcttcctgctgagcagcaggggtctgaagacaacttgaaaaccagtaccaccaaatgtattactggccaagaatcaaaaattgctccttcccacacaatgatccctccagctacttacagtgtagctctgttggctcctaaatgtgagcaggacttgactataaagaatgattatagtggcaaatggactgatcaagcatctgctgagaaaacaggagatgataacagcacaaggaaatcattccctgaggaaggagacataatggttactgtgtcttctgaagaaaatgtgtgtgacataggcaatgaagagtctccattgaatgttttgggaggattgaaactgaaagccaacttgaaaatggaggcttatgtgccttcagaggaagagaaaaatggtgaaattctggcaccaccagaaagtctgtgtgggggaaagccaagtggaatagctgaactccagagggagcctttgttggtgaatgaatcactaaatgttgaaaattcaggcttcagaacaaatgaagaaattcatagcgaatcttataacaaaggagagatatccagtggtagaaaagacaacgcagaagccataagcggtcacagtgttgaagcagatcctaaagaggttgaagaggaagaaaggcatatgcctaaaagaaaaagaaagcagcattatctctcttcagaagatgaaccagatgataatccagatgtcctggattccagaatagaaacagcacaaaggcagtgtcctgaaacggagccacatgacacaaaggaagagaactccagagatttggaagaattacctaaaaccagttctgagacaaatagcactacctcaagggtcatggaagaaaaagatgaatatagcagcagtgaaactactggtgaaaagccagagcagaacgatgatgacaccataaaatctcaggaggaagatcagccaataattattaaaaggaaaagaggaagacctcgcaaataccctgtagaaacaacgttaaaaatgaaagacgactccaaaacagatactggcattgtcactgtagaacaatctccatctagcagcaaactgaaagtaatgcaaacagatgaatccaataaagaaacagctaacctacaagaaagaagtataagcaatgatgatggtgaagaaaaaatagtaacaagtgtgcgtcggagaggaagaaaacccaaacgttctctcactgtatcagatgatgctgaatcctcagagccagaaagaaaacgccagaaatcagtttctgatccagtggaggacaagaaagagcaggagtctgatgaggaagaggaagaagaggaagaggacgagccttcaggagccaccacaagatccaccaccagatcagaggctcagagatcaaagacacagctctccccttctatcaagcgcaagagagaagtcagccctcctggggcccgaacaagaggccagcaaagggtggaggaagcccctgtgaaaaaagcgaagcgataatcctgaccactgctgccctaggcttatggaggaacacggtggagaggaaagagacatgccttggtggccataggcttctctttaaccaggaaaaagatatgcatgtgctgtaagtccctaggtgcaagctttttcttgttatgttttaaacagctttataaactattgttcatagaagatattatgtacatttatttcagataaaggacaataagtttactttgtatctgaactcaaaacaaagtagttgtatattttaacattcaaaattgggatttcccaatgtgacacatcatgaatgcaaacccctccagcccatcagacgccaggctgcctactggtaatctgtgtatagtatataaacatgtaaaaataggttgtattttactctatgtatgatgctaatcaatgaacactttatttattttacagagaaaacttatctgtgaactttactatatatctgtttattttactttattttttttttaaataaaaagggttttaaatgctatgcagtcattagtagaaaattttttaggactctgcctgctctgtaactatcttaatatgatctggcagaaactcgcatgtatccaagtaaagtagtttagctaaagaaaggttcttcattgcttttctgttcacagttgtggctctgttttttaagaatgtaacttgtttttagattatacttgcatctgtgactttactaccagccacgttgacacaaaacaggttctggttcaggtaaagttgcgtcagtcacctgcagcagaaatccctcttcattcctcttctctgtgttcattcctcttctgtgctgttctgaagcttctaccaatactctttccatattgtctttttcagtgaagagaaatgcattcaagattaggtccctcctgtctatccagtttcaggattttatgttgttttatacacagttatttcagtatagaaactggctttattgccaagtgtttttttaaacatgttttaactctcatatgagcaaactgtccaacttcagtttttcataagattaaacttcttacgatcaaatttgtctcttgcaatgatgtgatgagttgccaaataattgagattattttaaaatgttttgttcatattcttgttttataattaaaatttacattcagtgtgtatgggtttttttttttattttgactcttaatgtaaggtggatatttctgtcattttacatggtttcttactgagattttatatataaattataaaatgtttaccaaaaaaaaaaaa

SEQ ID NO: 319224 - DNA, 2508 bp, Homo sapiens
tacaacatggattgattgtgggaaataactggtcagatttttataatttatgaaagcagctaagccacttggtgacataggataggttccctatcctaaaaatcttcaaatttgtttctctgcatttcagaaacaatattcagtttctttacatctcatttttatttttgaacagctgaactccagagggagcctttgttggtgaatgaatcactaaatgttgaaaattcaggcttcagaacaaatgaagaaattcatagcgaatcttataacaaaggagagatatccagtggtagaaaagacaacgcagaagccataagcggtcacagtgttgaagcagatcctaaagaggttgaagaggaagaaaggcatatgcctaaaagaaaaagaaagcagcattatctctcttcagaagatgaaccagatgataatccagatgtcctggattccagaatagaaacagcacaaaggcagtgtcctgaaacggagccacatgacacaaaggaagagaactccagagatttggaagaattacctaaaaccagttctgagacaaatagcactacctcaagggtcatggaagaaaaagatgaatatagcagcagtgaaactactggtgaaaagccagagcagaacgatgatgacaccataaaatctcaggaggaagatcagccaataattattaaaaggaaaagaggaagacctcgcaaataccctgtagaaacaacgttaaaaatgaaagacgactccaaaacagatactggcattgtcactgtagaacaatctccatctagcagcaaactgaaagtaatgcaaacagatgaatccaataaagaaacagctaacctacaagaaagaagtataagcaatgatgatggtgaagaaaaaatagtaacaagtgtgcgtcggagaggaagaaaacccaaacgttctctcactgtatcagatgatgctgaatcctcagagccagaaagaaaacgccagaaatcagtttctgatccagtggaggacaagaaagagcaggagtctgatgaggaagaggaagaagaggaagaggacgagccttcaggagccaccacaagatccaccaccagatcagaggctcagagatcaaagacacagctctccccttctatcaagcgcaagagagaagtcagccctcctggggcccgaacaagaggccagcaaagggtggaggaagcccctgtgaaaaaagcgaagcgataatcctgaccactgctgccctaggcttatggaggaacacggtggagaggaaagagacatgccttggtggccataggcttctctttaaccaggaaaaagatatgcatgtgctgtaagtccctaggtgcaagctttttcttgttatgttttaaacagctttataaactattgttcatagaagatattatgtacatttatttcagataaaggacaataagtttactttgtatctgaactcaaaacaaagtagttgtatattttaacattcaaaattgggatttcccaatgtgacacatcatgaatgcaaacccctccagcccatcagacgccaggctgcctactggtaatctgtgtatagtatataaacatgtaaaaataggttgtattttactctatgtatgatgctaatcaatgaacactttatttattttacagagaaaacttatctgtgaactttactatatatctgtttattttactttattttttttttaaataaaaagggttttaaatgctatgcagtcattagtagaaaattttttaggactctgcctgctctgtaactatcttaatatgatctggcagaaactcgcatgtatccaagtaaagtagtttagctaaagaaaggttcttcattgcttttctgttcacagttgtggctctgttttttaagaatgtaacttgtttttagattatacttgcatctgtgactttactaccagccacgttgacacaaaacaggttctggttcaggtaaagttgcgtcagtcacctgcagcagaaatccctcttcattcctcttctctgtgttcattcctcttctgtgctgttctgaagcttctaccaatactctttccatattgtctttttcagtgaagagaaatgcattcaagattaggtccctcctgtctatccagtttcaggattttatgttgttttatacacagttatttcagtatagaaactggctttattgccaagtgtttttttaaacatgttttaactctcatatgagcaaactgtccaacttcagtttttcataagattaaacttcttacgatcaaatttgtctcttgcaatgatgtgatgagttgccaaataattgagattattttaaaatgttttgttcatattcttgttttataattaaaatttacattcagtgtgtatgggtttttttttttattttgactcttaatgtaaggtggatatttctgtcattttacatggtttcttactgagattttatatataaattataaaatgtttaccaaaaaaaaaaaa

SEQ ID NO: 319225 - DNA, 2581 bp, Homo sapiens
aagttttggattctagaacattttaaattttggatcatcagattagggatgctccgcctgtatatcattccaacttgcagttactggtacatattgtgggctccttatatgcccccttttttcttcttttttggggtcagaacatttaagctgaaagggaataagagtagtctaacccagccgggcgtggtggctcacacctgtaatcccagcactttgggaagccaaggcaggcagatcacctgaggtcaggagttcaagagtagcctggccaacatggtgaaaccccgtctctactaaaaatacaaaaaattagctggacatggtggtgggcacctgtaatctcagctactcaaggaggctgaggcaggagaattgcttgaacccaggaggcggaggttgcattgagccaagatcacgccactgcactccagcctgaatgactgagtgaaactctgtcttagaaaaaaaaaaaaagtagtctaatccaacttcttattttgcagctgaaaaaactgagggtcagcaaatttaaataaaatctgaaatgaaaacttatgtttcgtgactcacaatccaatgtgatctctgctaggtattctgattctatctttgcttgactgatacaagataatgatgaaatgtataacaatgtattaatactgatacattgacagacaagccaggctgattgttgaaatttaaatttacagtaataaaatattaatgcagagatttcccttttcttaaagatgaatccaataaagaaacagctaacctacaagaaagaagtataagcaatgatgatggtgaagaaaaaatagtaacaagtgtgcgtcggagaggaagaaaacccaaacgttctctcactgtatcagatgatgctgaatcctcagagccagaaagaaaacgccagaaatcagtttctgatccagtggaggacaagaaagagcaggagtctgatgaggaagaggaagaagaggaagaggacgagccttcaggagccaccacaagatccaccaccagatcagaggctcagagaaagcaacatagcaagccatctgcacgtgcaacatccaaacttggcagcccagacacagtttctcctagaaatcgccaaaaattagcaaaagagaagttacctaccagcgaaaaagttagtaactctcccccattaggaagatcaaagacacagctctccccttctatcaagcgcaagagagaagtcagccctcctggggcccgaacaagaggccagcaaagggtggaggaagcccctgtgaaaaaagcgaagcgataatcctgaccactgctgccctaggcttatggaggaacacggtggagaggaaagagacatgccttggtggccataggcttctctttaaccaggaaaaagatatgcatgtgctgtaagtccctaggtgcaagctttttcttgttatgttttaaacagctttataaactattgttcatagaagatattatgtacatttatttcagataaaggacaataagtttactttgtatctgaactcaaaacaaagtagttgtatattttaacattcaaaattgggatttcccaatgtgacacatcatgaatgcaaacccctccagcccatcagacgccaggctgcctactggtaatctgtgtatagtatataaacatgtaaaaataggttgtattttactctatgtatgatgctaatcaatgaacactttatttattttacagagaaaacttatctgtgaactttactatatatctgtttattttactttattttttttttaaataaaaagggttttaaatgctatgcagtcattagtagaaaattttttaggactctgcctgctctgtaactatcttaatatgatctggcagaaactcgcatgtatccaagtaaagtagtttagctaaagaaaggttcttcattgcttttctgttcacagttgtggctctgttttttaagaatgtaacttgtttttagattatacttgcatctgtgactttactaccagccacgttgacacaaaacaggttctggttcaggtaaagttgcgtcagtcacctgcagcagaaatccctcttcattcctcttctctgtgttcattcctcttctgtgctgttctgaagcttctaccaatactctttccatattgtctttttcagtgaagagaaatgcattcaagattaggtccctcctgtctatccagtttcaggattttatgttgttttatacacagttatttcagtatagaaactggctttattgccaagtgtttttttaaacatgttttaactctcatatgagcaaactgtccaacttcagtttttcataagattaaacttcttacgatcaaatttgtctcttgcaatgatgtgatgagttgccaaataattgagattattttaaaatgttttgttcatattcttgttttataattaaaatttacattcagtgtgtatgggtttttttttttattttgactcttaatgtaaggtggatatttctgtcattttacatggtttcttactgagattttatatataaattataaaatgtttaccaaaaaaaaaaaa

SEQ ID NO: 319226 - DNA, 7286 bp, Homo sapiens
  misc_feature (3895)..(3895): n is a, c, g, or t
gcggttcctcccttcagagaccaaaaaagagtggtgatatgacattgatccctgaacaagagccaatggaaattgattctgagccaggtgttgaaaatgtgtttgaagtatctaaaacccaagacaaccgcaataataattctcagcaagacattgactctgaaaatatgaaacaaaaaacttctgccactgttcaaaaggatgaattgagaacttgcacagcagattcaaaagcaacagctccagcttataagccaggccgtggaacaggagttaatagtaattctgaaaagcatgccgatcatagaagcaccttgaccaagaaaatgcatatacaaagtgctgtgtccaaaatgaaccctggggagaaagaacccattcatagaggaactactgaagtgaatatagattctgaaactgttcatagaatgttactgagtgccccatcagaaaatgatagggtacagaagaatttgaaaaacacagctgctgaagaacatgttgctcaaggagatgccactcttgaacattccacaaatttagactcctcaccatccttaagttcagtgactgttgtgcctctgagggaatcgtatgatccagatgtaattcctctgtttgacaaaagaactgttttggaaggtagcacagccagcacctcccctgcggatcactctgctctccctaaccaaagtctgactgttagggaatcagaagtccttaagacaagtgacagcaaagaaggtggtgaaggtttcacagtagatacaccagcaaaagcaagcatcactagcaaaagacacattccagaagctcaccaggctactttattggatggtaaacaaggaaaggtaatcatgcctcttggaagtaagttaacgggcgtgattgtggaaaatgagaatattaccaaagaaggtggcttagtggacatggccaagaaagaaaatgacttaaatgcagagcccaatttaaagcagacaattaaagcaacagtagagaatggcaagaaggatggcattgctgttgatcatgttgtaggcctgaatacagaaaaatatgctgaaactgtcaaacttaagcataaaagaagcccaggtaaagtaaaagacatatcaattgatgttgaaagaaggaatgaaaacagtgaggtagacaccagtgctggaagtggctctgcaccctctgttttacaccaaaggaacggacaaactgaggatgtggcaactgggcctaggagagcagaaaagacttctgttgccactagtactgaagggaaggacaaagatgtcaccttaagtccagtgaaggctgggcctgccacaaccacttcttcagaaacaagacaaagtgaggtggctttgccttgcaccagcattgaggcagatgaaggcctcataataggaacacattccagaaataatcctcttcatgttggtgcagaagccagtgaatgcactgtttttgctgcagctgaagaaggtggggctgttgtcacagagggatttgctgaaagtgaaaccttcctcacaagcactaaggaaggggaaagtggggagtgtgctgtggctgaatctgaggacagagcagcagacctactggctgtgcatgcagttaaaatcgaagccaatgtaaatagcgttgtgacagaggaaaaggatgatgctgtaaccagtgcaggctctgaagaaaaatgtgatggttctttaagtagagactcagaaatagttgaaggaactattacttttattagtgaagttgaaagtgatggagcagttacaagtgctggaacagagataagagcaggatctataagcagtgaagaggtggatggctcccagggaaatatgatgagaatgggtcccaaaaaagaaacagagggcactgtgacatgtacaggagcagaaggcagaagtgataactttgtgatctgctcagtaactggagcagggccccgggaggaacgcatggttacaggtgcaggtgttgtcctgggagataatgatgcaccaccaggaacaagtgccagccaagaaggagatggttctgtgaatgatggtacagaaggtgagagtgcagtcaccagcacggggataacagaagatggagaggggccagcaagttgcacaggttcagaagatagcagcgaaggctttgctataagttctgaatcggaagaaaatggagagagtgcaatggacagcacagtggccaaagaaggcactaatgtaccattagttgctgctggtccttgtgatgatgaaggcattgtgactagcacaggcgcaaaagaggaagacgaggaaggggaggatgttgtgactagtactggaagaggaaatgaaattgggcatgcttcaacttgtacagggttaggagaagaaagtgaaggggtcttgatttgtgaaagtgcagaaggggacagtcagattggtactgtggtagagcatgtggaagctgaggctggagctgccatcatgaatgcaaatgaaaataatgttgacagcatgagtggcacagagaaaggaagtaaagacacagatatctgctccagtgcaaaagggattgtagaaagcagtgtgaccagtgcagtctcaggaaaggatgaagtgacaccagttccaggaggttgtgagggtcctatgactagtgctgcatctgatcaaagtgacagtcagctcgaaaaagttgaagataccactatttccactggcctggtcgggggtagttacgatgttcttgtatctggtgaagtcccagaatgtgaagttgctcacacatcaccaagtgaaaaagaagatgaggacatcatcacctctgtagaaaatgaagagtgtgatggtctcatggcaactacagccagtggtgatattaccaaccagaatagcttagcagggggtaaaaatcaaggcaaagttttgattatttccaccagtaccacaaatgattacacccctcaggtaagcgcaattacagatgtggaaggaggtctctcagatgctctgagaactgaagaaaatatggaaggtaccagagtaaccacagaagaatttgaggcccccatgcccagtgcagtctcaggagatgacagccaactcactgccagcagaagtgaagagaaagatgagtgtgccatgatttccacaagcataggggaagaattcgaattgcctatctccagtgcaacaaccatcaagtgtgctgaaagtcttcagccggttgctgcagcagtggaagaaagggctacaggtccagtcttgataagcaccgccgactttgaggggcctatgcccagtgcgcccccagaagctgaaagtcctcttgcctcaaccagcaaggaggagaaggatgaatgtgctctcatttccactagcatagcagaagaatgtgaggcttctgtttccggtgtagttgttgaaagtgaaaatgagcgagctggcacagtcatggaagaaaaagacgggagtggcatcatctctacgagctcggtggaagactgtgagggcccagtgtccagtgctgtccctcaagaggaaggcgacccctcagtcacaccagcggaagagatgggtgacaccgccatgatttccacaagcacctctgaagggtgtgaagcagtcatgattggtgctgtcctccaggatgaagatcggctcaccatcacaagagtagaagacttgagcgatgctgccatcatctccaccagcacagcagaatgtatgccaatttccgccagcattgacagacatgaagagaatcagctgactgcagacaacccagaagggaacggtgacctgtcagccacagaagtgagcaagcacaaggtccccatgcccagcctaattgctgagaataactgtcggtgtcctgggccagtcaggggaggcaaagaacngggtcccgtgttggcagtgagcaccgaggaggggcacaacgggccatcagtccacaagccctctgcagggcaaggccatccaagtgctgtttgtgcggaaaaagaagagaagcatggcaaggagtgccccgaaataggaccatttgcaggaagaggacagaaagagagcactttacacctcataaatgcagaagagaagaatgtattgttgaactcccttcagaaagaagataagagcccagagacagggacagcagggggcagtagcacagcaagttattcagcaggaaggggcttagaggggaatgctaactcacctgcccacctgagaggaccagaacagacgtctgggcagacggctaaggatccctctgtcagcattcgctatttggcagcagtaaacaccggtgctataaaagctgatgacatgccacctgttcaagggaccgtggctgagcattcctttcttcctgctgagcagcaggggtctgaagacaacttgaaaaccagtaccaccaaatgtattactggccaagaatcaaaaattgctccttcccacacaatgatccctccagctacttacagtgtagctctgttggctcctaaatgtgagcaggacttgactataaagaatgattatagtggcaaatggactgatcaagcatctgctgagaaaacaggagatgataacagcacaaggaaatcattccctgaggaaggagacataatggttactgtgtcttctgaagaaaatgtgtgtgacataggcaatgaagagtctccattgaatgttttgggaggattgaaactgaaagccaacttgaaaatggaggcttatgtgccttcagaggaagagaaaaatggtgaaattctggcaccaccagaaagtctgtgtgggggaaagccaagtggaatagctgaactccagagggagcctttgttggtgaatgaatcactaaatgttgaaaattcaggcttcagaacaaatgaagaaattcatagcgaatcttataacaaaggagagatatccagtggtagaaaagacaacgcagaagccataagcggtcacagtgttgaagcagatcctaaagaggttgaagaggaagaaaggcatatgcctaaaagaaaaagaaagcagcattatctctcttcagaagatgaaccagatgataatccagatgtcctggattccagaatagaaacagcacaaaggcagtgtcctgaaacggagccacatgacacaaaggaagagaactccagagatttggaagaattacctaaaaccagttctgagacaaatagcactacctcaagggtcatggaagaaaaagatgaatatagcagcagtgaaactactggtgaaaagccagagcagaacgatgatgacaccataaaatctcaggaggaagatcagccaataattattaaaaggaaaagaggaagacctcgcaaataccctgtagaaacaacgttaaaaatgaaagacgactccaaaacagatactggcattgtcactgtagaacaatctccatctagcagcaaactgaaagtaatgcaaacagatgaatccaataaagaaacagctaacctacaagaaagaagtataagcaatgatgatggtgaagaaaaaatagtaacaagtgtgcgtcggagaggaagaaaacccaaacgttctctcactgtatcagatgatgctgaatcctcagagccagaaagaaaacgccagaaatcagtttctgatccagtggaggacaagaaagagcaggagtctgatgaggaagaggaagaagaggaagaggacgagccttcaggagccaccacaagatccaccaccagatcagaggctcagagaaagcaacatagcaagccatctgcacgtgcaacatccaaacttggcagcccagacacagtttctcctagaaatcgccaaaaattagcaaaagagaagttacctaccagcgaaaaagttagtaactctcccccattaggaagatcaaagacacagctctccccttctatcaagcgcaagagagaagtcagccctcctggggcccgaacaagaggccagcaaagggtggaggaagcccctgtgaaaaaagcgaagcgataatcctgaccactgctgccctaggcttatggaggaacacggtggagaggaaagagacatgccttggtggccataggcttctctttaaccaggaaaaagatatgcatgtgctgtaagtccctaggtgcaagctttttcttgttatgttttaaacagctttataaactattgttcatagaagatattatgtacatttatttcagataaaggacaataagtttactttgtatctgaactcaaaacaaagtagttgtatattttaacattcaaaattgggatttcccaatgtgacacatcatgaatgcaaacccctccagcccatcagacgccaggctgcctactggtaatctgtgtatagtatataaacatgtaaaaataggttgtattttactctatgtatgatgctaatcaatgaacactttatttattttacagagaaaacttatctgtgaactttactatatatctgtttattttactttattttttttttaaataaaaagggttttaaatgctatgcagtcattagtagaaaattttttaggactctgcctgctctgtaactatcttaatatgatctggcagaaactcgcatgtatccaagtaaagtagtttagctaaagaaaggttcttcattgcttttctgttcacagttgtggctctgttttttaagaatgtaacttgtttttagattatacttgcatctgtgactttactaccagccacgttgacacaaaacaggttctggttcaggtaaagttgcgtcagtcacctgcagcagaaatccctcttcattcctcttctctgtgttcattcctcttctgtgctgttctgaagcttctaccaatactctttccatattgtctttttcagtgaagagaaatgcattcaagattaggtccctcctgtctatccagtttcaggattttatgttgttttatacacagttatttcagtatagaaactggctttattgccaagtgtttttttaaacatgttttaactctcatatgagcaaactgtccaacttcagtttttcataagattaaacttcttacgatcaaatttgtctcttgcaatgatgtgatgagttgccaaataattgagattattttaaaatgttttgttcatattcttgttttataattaaaatttacattcagtgtgtatgggtttttttttttattttgactcttaatgtaaggtggatatttctgtcattttacatggtttcttactgagattttatatataaattataaaatgtttaccaaaaaaaaaaaa

SEQ ID NO: 319227 - DNA, 600 bp, Homo sapiens
  misc_feature (594)..(595): n is a, c, g, or t
  misc_feature (597)..(600): n is a, c, g, or t
ccatgatggctccgtctcattctgtcacagatcgtctttataagccagacatgtcagtgctataaactgatgagacacccacagaatttaacagaaatcgaaggtgtggaaaggatctcagacaagcgaatccatcactgttactgtacagataagaaatggaggccaaataggattagcaacttgctcaggactccacagaaagagcagcaactggatggcacagaatgagttctgacgtttacatcagaagatggccctgaaccggagccaaagctggccgaggagctgggggagattctgagactcacactttcatttgtgaagtgagatgctgactctattgttggttttgtttgggggtttgatgctgaaataaagcaatacacacgaggaaatttactggcattgtattaaaaaacaaagttaatgtatgatgatgccgtagagtgattcatgaatggcattatgaatattttaaaaacacaaaaggaattaaaagagtatacttggatgttaatgaaaataaaatttcattgagaacaagaatcttggtaaacatcagttgatattaaaaatttattgcttttaaannannnn

SEQ ID NO: 319228 - DNA, 547 bp, Homo sapiens
ccatgatggctccgtctcattctgtcacagatcgtctttataagccagacatgtcagtgctataaactgatgagacacccacagaatttaacagaaatcgaaggtgtggaaaggatctcagacaagcgaatccatcactgttactgtacagataagaaatggaggccaaataggattagcaacttgctcaggactccacagaaagagcagcaactggatggcacagaatgagttctgacgtttacatcagaagatggccctgaaccggagccaaagctggccgaggagctgggggagattctgagactcacactttcatttgtgaagtgagatgctgactctattgttggttttgtttgggggtttgatgctgaaataaagcaatacacacgaggaaatttactggcattgtattaaaaaacaaagttaatgtatgatgatgccgtagagtgattcatgaatggcattatgaatattttaaaaacacaaaaggaattaaaagagtatacttggatgttaatgaaaataaaatttcattgagaacaag

SEQ ID NO: 319229 - DNA, 702 bp, Homo sapiens
  misc_feature (702)..(702): n is a, c, g, or t
agactcaacaagagctccagcaaagactttcactgtagcttgacttgacctgagattaactagggaatcttgagaataaagatgagctctgaaaattgtttcgtagcagagaacagctctttgcatccggagagtggacaagaaaatgatgccaccagtccccatttctcaacacgtcatgaagggtccttccaagttcctgtcctgtgtgctgtaatgaatgtggtcttcatcaccattttaatcatagctctcattgccttatcagtgggccaatacaattgtccaggccaatacacattctcaatgccatcagacagccatgtttcttcatgctctgaggactgggttggctaccagaggaaatgctactttatttctactgtgaagaggagctggacttcagcccaaaatgcttgttctgaacatggtgctactcttgctgtcattgattctgaaaaggacatgaactttctaaaacgatacgcaggtagagaggaacactgggttggactgaaaaaggaacctggtcacccatggaagtggtcaaatggcaaagaatttaacaactggttcaacgttacagggtctgacaagtgtgtctttctgaacccttacaatataaggaaccggttacttattggctatattgagggaactaaggaaaccgggccagcgatgctgctctgggccgaaacctcn

SEQ ID NO: 319230 - DNA, 1354 bp, Homo sapiens
agactcaacaagagctccagcaaagactttcactgtagcttgacttgacctgagattaactagggaatcttgagaataaagatgagctctgaaaattgtttcgtagcagagaacagctctttgcatccggagagtggacaagaaaaactttctaaaacgatacgcaggtagagaggaacactgggttggactgaaaaaggaacctggtcacccatggaagtggtcaaatggcaaagaatttaacaactggttcaacgttacagggtctgacaagtgtgtttttctgaaaaacacagaggtcagcagcatggaatgtgagaagaatttatactggatatgtaacaaaccttacaaataataaggaaacgtgttcacttattgactattatagaatggaactcaaggaaatctgtgtcagtggatgctgctctgtggtccgaagtcttccatagagactttgtgaaaaaaaattttatagtgtcttgggaattttcttccaaacagaactatggaaaaaaaggaagaaattccaggaaaatctgcactgtgggcttttattgccatgagctagaagcatcacaggttgaccaataaccatgcccaagaatgagaagaatgactatgcaacctttggatgcactttatattattttgaatccagaaataatgaaataactaggcgtggacttactatttattgctgaatgactaccaacagtgagagcccttcatgcatttgcactactggaaggagttagatgttggtactagatactgaatgtaaacaaaggaattatggctggtaacataggtttttagtctaattgaatcccttaaactcagggagcatttataaatggacaaatgcttatgaaattaagatttgtaatatttctctctttttagagaaatttgccaatttactttgttatttttccccaaaaagaatgggatgatcgtgtatttatttttttacttcctcagctgtagacaggtccttttcgatggtacatatttctttgcctttataatcttttatacagtgtcttacagagaaaagacataagcaaagactatgaggaatatttgcaagacatagaatagtgttggaaaatgtgcaatatgtgatgtggcaaatctctattaggaaatattctgtaatcttcagacctagaataatactagtcttataataggtttgtgactttcctaaatcaattctattacgtgcaatacttcaatacttcatttaaaatatttttatgtgcaataaaatgtatttgtttgtattttgtgttcagtacaattataagctgtttttatatatgtgaaataaaagtagaataaacacaat

SEQ ID NO: 319231 - DNA, 481 bp, Homo sapiens
attttcagaattgttctatatttctgtcattttctgacattatgaccaaaagtacatcccctcatcctcatatctccatccaatgatgattaggcacaatggaagatcagatatggtcctgagaactttctttcttcatacccttttcagaattctactttttagcttttatcctttactttatcaccacctagcacaacatagcatcctaaggctagttttgcatgctgtgggtatttggtttcttttgttactaaaacaaagcatttttctgttcacagtgggccaatacaattgtccaggccaatacacattctcaatgccatcagacagccatgtttcttcatgctctgaggactgggttggctaccagaggaaatgctactttatttctactgtgaagaggagctggacttcagcccaaaatgcttgttctgaacatggtgctactcttgctgtcattgattctgaaaaggacatg

SEQ ID NO: 319232 - DNA, 433 bp, Homo sapiens
cagaaatgaccaagaatcacttatctggtgccatgccaaccaaatgaatggcgtgctttcctcttacttccatattttttctccacatcctatttttttttcaattcttgtccattgtctctacagattagtctatgattatttgacttgtgtatcccactaagaatttaaaagaagcagaggtcaccatctccgagttcattctcatgtaactgaatgaaaacaatgagctgaaaataattctaagtttttttattgtttgacaggttcaacgttacagggtctgacaagtgtgtttttctgaaaaacacagaggtcagcagcatggaatgtgagaagaatttatactggatatgtaacaaaccttacaaataataaggaaacgtgttcacttattgactattatagaatggaactcaaggaaatctgtgtc

SEQ ID NO: 319233 - DNA, 440 bp, Homo sapiens
atttgccaatttactttgttatttttccccaaaaagaatgggatgatcgtgtatttatttttttacttcctcagctgtagacaggtccttttcgatggtacatatttctttgcctttataatcttttatacagtgtcttacagagaaaagacataagcaaagactatgaggaatatttgcaagacatagaatagtgttggaaaatgtgcaatatgtgatgtggcaaatctctattaggaaatattctgtaatcttcagacctagaataatactagtcttataataggtttgtgactttcctaaatcaattctattacgtgcaatacttcaatacttcatttaaaatatttttatgtgcaataaaatgtatttgtttgtattttgtgttcagtacaattataagctgtttttatatatgtgaaataaaagtagaataaaca

SEQ ID NO: 319234 - DNA, 1677 bp, Homo sapiens
agactcaacaagagctccagcaaagactttcactgtagcttgacttgacctgagattaactagggaatcttgagaataaagatgagctctgaaaattgtttcgtagcagagaacagctctttgcatccggagagtggacaagaaaatgatgccaccagtccccatttctcaacacgtcatgaagggtccttccaagttcctgtcctgtgtgctgtaatgaatgtggtcttcatcaccattttaatcatagctctcattgccttatcagtgggccaatacaattgtccaggccaatacacattctcaatgccatcagacagccatgtttcttcatgctctgaggactgggttggctaccagaggaaatgctactttatttctactgtgaagaggagctggacttcagcccaaaatgcttgttctgaacatggtgctactcttgctgtcattgattctgaaaaggacatgaactttctaaaacgatacgcaggtagagaggaacactgggttggactgaaaaaggaacctggtcacccatggaagtggtcaaatggcaaagaatttaacaactggttcaacgttacagggtctgacaagtgtgtttttctgaaaaacacagaggtcagcagcatggaatgtgagaagaatttatactggatatgtaacaaaccttacaaataataaggaaacgtgttcacttattgactattatagaatggaactcaaggaaatctgtgtcagtggatgctgctctgtggtccgaagtcttccatagagactttgtgaaaaaaaattttatagtgtcttgggaattttcttccaaacagaactatggaaaaaaaggaagaaattccaggaaaatctgcactgtgggcttttattgccatgagctagaagcatcacaggttgaccaataaccatgcccaagaatgagaagaatgactatgcaacctttggatgcactttatattattttgaatccagaaataatgaaataactaggcgtggacttactatttattgctgaatgactaccaacagtgagagcccttcatgcatttgcactactggaaggagttagatgttggtactagatactgaatgtaaacaaaggaattatggctggtaacataggtttttagtctaattgaatcccttaaactcagggagcatttataaatggacaaatgcttatgaaattaagatttgtaatatttctctctttttagagaaatttgccaatttactttgttatttttccccaaaaagaatgggatgatcgtgtatttatttttttacttcctcagctgtagacaggtccttttcgatggtacatatttctttgcctttataatcttttatacagtgtcttacagagaaaagacataagcaaagactatgaggaatatttgcaagacatagaatagtgttggaaaatgtgcaatatgtgatgtggcaaatctctattaggaaatattctgtaatcttcagacctagaataatactagtcttataataggtttgtgactttcctaaatcaattctattacgtgcaatacttcaatacttcatttaaaatatttttatgtgcaataaaatgtatttgtttgtattttgtgttcagtacaattataagctgtttttatatatgtgaaataaaagtagaataaacacaat

SEQ ID NO: 319235 - DNA, 2048 bp, Homo sapiens
agactcaacaagagctccagcaaagactttcactgtagcttgacttgacctgagattaactagggaatcttgagaataaagatgagctctgaaaattgtttcgtagcagagaacagctctttgcatccggagagtggacaagaaaatgatgccaccagtccccatttctcaacacgtcatgaagggtccttccaagttcctgtcctgtgtgctgtaatgaatgtggtcttcatcaccattttaatcatagctctcattgccttatcagtgggccaatacaattgtccaggccaatacacattctcaatgccatcagacagccatgtttcttcatgctctgaggactgggttggctaccagaggaaatgctactttatttctactgtgaagaggagctggacttcagcccaaaatgcttgttctgaacatggtgctactcttgctgtcattgattctgaaaaggacatggtaagaataaaaaaaagataaaatactactattttaattcatatggctaatcagtgctttccttccgtttctaagtggagaaaacaaacaaacaaacaaacattgtacctatttcagatgtaggaaaatgtcatcccagagaaccatatgatcagcctgaggtcaaaatgagatttaatttaatcttttaaatttgatttgattgcttagcttcaaagaccagaaatccaaatatgctgatcctatatagaatgagtacatggtcagataagctgtcatgcctcaagttgcagcttttgagaaacaggatttactatctacttccccagaagggtgtttaatgtaacaaactcctttgtgctttctttaagaactttctaaaacgatacgcaggtagagaggaacactgggttggactgaaaaaggaacctggtcacccatggaagtggtcaaatggcaaagaatttaacaactggttcaacgttacagggtctgacaagtgtgtttttctgaaaaacacagaggtcagcagcatggaatgtgagaagaatttatactggatatgtaacaaaccttacaaataataaggaaacgtgttcacttattgactattatagaatggaactcaaggaaatctgtgtcagtggatgctgctctgtggtccgaagtcttccatagagactttgtgaaaaaaaattttatagtgtcttgggaattttcttccaaacagaactatggaaaaaaaggaagaaattccaggaaaatctgcactgtgggcttttattgccatgagctagaagcatcacaggttgaccaataaccatgcccaagaatgagaagaatgactatgcaacctttggatgcactttatattattttgaatccagaaataatgaaataactaggcgtggacttactatttattgctgaatgactaccaacagtgagagcccttcatgcatttgcactactggaaggagttagatgttggtactagatactgaatgtaaacaaaggaattatggctggtaacataggtttttagtctaattgaatcccttaaactcagggagcatttataaatggacaaatgcttatgaaattaagatttgtaatatttctctctttttagagaaatttgccaatttactttgttatttttccccaaaaagaatgggatgatcgtgtatttatttttttacttcctcagctgtagacaggtccttttcgatggtacatatttctttgcctttataatcttttatacagtgtcttacagagaaaagacataagcaaagactatgaggaatatttgcaagacatagaatagtgttggaaaatgtgcaatatgtgatgtggcaaatctctattaggaaatattctgtaatcttcagacctagaataatactagtcttataataggtttgtgactttcctaaatcaattctattacgtgcaatacttcaatacttcatttaaaatatttttatgtgcaataaaatgtatttgtttgtattttgtgttcagtacaattataagctgtttttatatatgtgaaataaaagtagaataaacacaat

SEQ ID NO: 319236 - DNA, 2935 bp, Homo sapiens
aggcgcctgcgctttagctgctaactcgctctagtagctgtggtcggggctcgggaccggctgccatcttagtctagggactgaggagtcgccgccgccccgagtcccggtaccatgcatttcacggtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcattta

SEQ ID NO: 319237 - DNA, 958 bp, Homo sapiens
cacaatgaaacaatgggaagacccagaaagtcaggtcaattaaatgaaaagcccttacctgaaggttgggaaatgagattcacagtggatggaattccatattttgtggaccacaatagaagaactaccacctatatagatccccgcacaggaaaatctgccctgtaagttttctaaacattgtagattaagagtaaaatactagtccttcagattttgatataaagatttgtattagcaaggagtggaagtcttagtatttcttgagttagcttgacaataggtttctgttcattaagtattttgcatttccatctccctcttggatattttatcctagagattttcatatttgttaccatttgttcacacagcactaaatgaaactatttagaatttataggtattgtactgcttaccaattagtctctgatttctgattttcagcttctttcattcccttaactttttgacgttaaaaaagctctcattacttatcccccaccccatttctgagaaagtaaccttttgatttgcttatgtgctttatgacttcttttgtgggaaaatatataacctaaagtttcttgttttatgtgtacagttcagtggcattaagcacattcatattgtggcataatcattaccaccatccatctccagaatgttttcatcattccacactgaaacactgtaccctttaaacaataactttagcagacctggtaaccagccttctactgtctttctctatgaatttgactagtcgaagtacctcatattattggagtcatacaatatttatgcttatgtttctggattatttcactaaggtcatatcttcaagatttatccgtgttgtaatatgtatcaacattttcattccttattgaagctgaataatattccagtgtatgtatatatcacattttgtttattcacagatattgcattgttt

SEQ ID NO: 319238 - DNA, 728 bp, Homo sapiens
ccacctttgcctctcaaagtactgggataacagacatgagccaccacacctaacccagagtttctgaattagtaagatgatgtgtggggcctgaggatttatggttctaacaagttccctcatgatgctgatgcttgttggattggggaacacagtttgagatccactatactaacaaactgtttatgatttcattatgttttagggagcaatggaccacagaaattctgcattgaaaaagttgggaaagaaaattggctacccagaagtcatacctggtaagtacaatcagaatggatagagaaaacagcttttgtccagttatctgtagctatttaaagccagctagaaattaaaaatgatatttagtagatttacagaatagcacagccatcatagcaatccagtttaagagcattttgttcacccctgtatgattccttacaactatttgcaatcaattccttttttcacatctgaattttttttctaatgtgggatttagagttattttaacttttctctgagggcagccaaagaaagttaggagacctactttctaacatcatgaccaccaatattctcatttgaaatctaattacatttctaaaaatgtagaaaactaaatctaatcctaatctgacagcaaatatattaatattttggaattcaacctaatgtcaacaatatttgcccgtcgtgcgcgtggggtcctctaggacgccgca

SEQ ID NO: 319239 - DNA, 6381 bp, Homo sapiens
aggcgcctgcgctttagctgctaactcgctctagtagctgtggtcggggctcgggaccggctgccatcttagtctagggactgaggagtcgccgccgccccgagtcccggtaccatgcatttcacggtggccttgtggagacaacgccttaacccaaggaagttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatatgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttcaaaaaaatgctt

SEQ ID NO: 319240 - DNA, 6529 bp, Homo sapiens
aggcgcctgcgctttagctgctaactcgctctagtagctgtggtcggggctcgggaccggctgccatcttagtctagggactgaggagtcgccgccgccccgagtcccggtaccatgcatttcacggtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaaatggggtttcgctctgtttgcccaggctggagtgcaatagtgcgatctcggctcactgcaacctctgcctcccgggtttaagtgattctcctatctcagcctcccgagtagctgggtttacaggtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatatgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttcaaaaaaatgctt

SEQ ID NO: 319241 - DNA, 6453 bp, Homo sapiens
aggcgcctgcgctttagctgctaactcgctctagtagctgtggtcggggctcgggaccggctgccatcttagtctagggactgaggagtcgccgccgccccgagtcccggtaccatgcatttcacggtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagggtagtgataatatgaatactcagaacttagttcctttcctccaaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatatgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttcaaaaaaatgctt

SEQ ID NO: 319242 - DNA, 4864 bp, Homo sapiens
tactcacagatgcattggtaaacattattgaatataaatttatattcatagtctacttgtttctgtaaggaaagataaaagtaaataaaactttccccttttgatttttttgataggctattttaatgatgagagttgacttaagtcattcttctatttcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatatgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttcaaaaaaatgctt

SEQ ID NO: 319243 - DNA, 4777 bp, Homo sapiens
aggtatataaaaatatagatgtatataataaaatattattaaacgttactataatgtattttctgtatgtgtggttttgactagaccatgaacacctttctgtgtcatgggagatttcagttacctataacgaaggagatgtcaaacctagaagtggtagacagtgtttcaatagcttttttcaccaattattttactttatttttttttagataatgagcttcagtccccaagatctgcgaagacgtttgtgggtgatttttccaggagaagaaggtttagattatggaggtgtagcaagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatatgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttcaaaaaaatgctt

SEQ ID NO: 319244 - DNA, 3577 bp, Homo sapiens
aggcgcctgcgctttagctgctaactcgctctagtagctgtggtcggggctcgggaccggctgccatcttagtctagggactgaggagtcgccgccgccccgagtcccggtaccatgcatttcacggtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttcaaaaaaatgctt

SEQ ID NO: 319245 - DNA, 3146 bp, Homo sapiens
aggcgcctgcgctttagctgctaactcgctctagtagctgtggtcggggctcgggaccggctgccatcttagtctagggactgaggagtcgccgccgccccgagtcccggtaccatgcatttcacggtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctggtaagtacaatcagaatggatagagaaaacagcttttgtccagttatctgtagctatttaaagccagctagaaattaaaaatgatatttagtagatttacagaatagcacagccatcatagcaatccagtttaagagcattttgttcacccctgtatgattccttacaactatttgcaatcaattccttttttcacatctgaattttttttctaatgtgggatttagagttattttaacttttctctgagggcagccaaagaaagttaggagacctactttctaacatcatgaccaccaatattctcatttgaaatctaattacatttctaaaaatgtagaaaactaaatctaatcctaatctgacagcaaatatattaatattttggaattcaacctaatgtcaacaatatttgcccgtcgtgcgcgtggggtcctctaggacgccgca

SEQ ID NO: 319246 - DNA, 3644 bp, Homo sapiens
attagcaaaggcaacttttggtgttaatcatgcagtttatggaatcgtttctgctgtacagcataaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatatgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttcaaaaaaatgctt

SEQ ID NO: 319247 - DNA, 3449 bp, Homo sapiens
  misc_feature (130)..(130): n is a, c, g, or t
  misc_feature (134)..(134): n is a, c, g, or t
  misc_feature (138)..(138): n is a, c, g, or t
  misc_feature (157)..(158): n is a, c, g, or t
  misc_feature (165)..(165): n is a, c, g, or t
  misc_feature (173)..(174): n is a, c, g, or t
  misc_feature (178)..(178): n is a, c, g, or t
  misc_feature (206)..(206): n is a, c, g, or t
  misc_feature (251)..(251): n is a, c, g, or t
  misc_feature (253)..(253): n is a, c, g, or t
  misc_feature (272)..(272): n is a, c, g, or t
  misc_feature (290)..(290): n is a, c, g, or t
tgccaaatcccattgaatttggtctggtcttttcaaaaagattaaaaaatttttgaacaatacatttttatcaaaaccaaccaaatcatagttaaactgtggtttggggtacttttaaattcccaattanccangcanttaaaaggggagcaagtannacatcanaaaacatnnaagngctcaaattgcaaataaactgcaacttnctattgaacatagaattcaaaacaaaaggctttggccataactgnanacaaaaaaatggtgggagnaaatcagtatttcaaaanaaaacggcaggaacctcgtgccgaattcggcacgagttttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttcaaaaaaatgctt

SEQ ID NO: 319248 - DNA, 2425 bp, Homo sapiens
aggcgcctgcgctttagctgctaactcgctctagtagctgtggtcggggctcgggaccggctgccatcttagtctagggactgaggagtcgccgccgccccgagtcccggtaccatgcatttcacggtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctgtaagttttctaaacattgtagattaagagtaaaatactagtccttcagattttgatataaagatttgtattagcaaggagtggaagtcttagtatttcttgagttagcttgacaataggtttctgttcattaagtattttgcatttccatctccctcttggatattttatcctagagattttcatatttgttaccatttgttcacacagcactaaatgaaactatttagaatttataggtattgtactgcttaccaattagtctctgatttctgattttcagcttctttcattcccttaactttttgacgttaaaaaagctctcattacttatcccccaccccatttctgagaaagtaaccttttgatttgcttatgtgctttatgacttcttttgtgggaaaatatataacctaaagtttcttgttttatgtgtacagttcagtggcattaagcacattcatattgtggcataatcattaccaccatccatctccagaatgttttcatcattccacactgaaacactgtaccctttaaacaataactttagcagacctggtaaccagccttctactgtctttctctatgaatttgactagtcgaagtacctcatattattggagtcatacaatatttatgcttatgtttctggattatttcactaaggtcatatcttcaagatttatccgtgttgtaatatgtatcaacattttcattccttattgaagctgaataatattccagtgtatgtatatatcacattttgtttattcacagatattgcattgttt

SEQ ID NO: 319249 - DNA, 2032 bp, Homo sapiens
aggcgcctgcgctttagctgctaactcgctctagtagctgtggtcggggctcgggaccggctgccatcttagtctagggactgaggagtcgccgccgccccgagtcccggtaccatgcatttcacggtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctgtaagttttctaaacattgtagattaagagtaaaatactagtccttcagattttgatataaagatttgtattagcaaggagtggaagtcttagtatttcttgagttagcttgacaataggtttctgttcattaagtattttgcatttccatctccctcttggatattttatcctagagattttcatatttgttaccatttgttcacacagcactaaatgaaactatttagaatttataggtattgtactgctcagccaggatgtctcctcagtcactagacgttcgatgcatcgtcgatccacgaccacatgttttgacgtttgcagtctgattataagagatccccctcctcatgtaacggcgatgtatactatgtgcgtcttcataaacgggccgagct

SEQ ID NO: 319250 - DNA, 293 bp, Homo sapiens
gtaagtcacatgagtttcttcatggagttctgtcatttcatttttgttctcttccaattgtgtcattttaaaacagatatttatgtctgatactgtgctcttgcttgagtgaatgtctgggaagtttttttttaatatatatatcagtttaattcacaaataggcattaaattccccaaacattaagtggactctttataaacttttattgacgctcataattattttactcttctacagtttaaagatactgatcacccagcaataaaaaaggaatgggctattgatacacc

SEQ ID NO: 319251 - DNA, 387 bp, Homo sapiens
tttcgtgtgtggagtcaccagacactgaaatctgatgttttgttgggaactgctgcattagatatttatgaaacattaaagtcaaacaatatgaaacgtatgtatgtaagactaatagaaattgcacttagctgtttgtttttctggaagaaatttatatgtcaaacatgcataatgactcatgttctctcatacttttaagttttacttggttataggatgaacagatagaagaattttacactattgaaagtattctgagtaaccttggtttgaccattcattttggattcagtatttttagtaaatatttatttacttagtaaatagatattagtaaagtaatacatatttaattgtggaaaaactaaaatatagagcagagat

SEQ ID NO: 319252 - DNA, 310 bp, Homo sapiens
tgcaggataagcagttttacttttgttgacaatatgtgtatgaatttacttctgtagttcaactgcaagtgaaaatgaccatgtaagcatgtagcattcagataattttcataagattactgaacataggccaatattgattgtatagtaaactgtaaggggtgcagtgagaagactttagactttaaaactgaattgtaatttatttaggatctcattgtgatattcaataaaaataatattttttccctcttttttcacttttagtatcgttacccctgtgagtaaattacattttcgtgtgtggagt

SEQ ID NO: 319253 - DNA, 348 bp, Homo sapiens
aaactcattttctgtttaaactttgatgttaaaggtgcttctcagaatgatgatggctccagatccaaggatgaaacaaggtaagcattcactgattgcttaccacagaatgcggagagatagatttcctaaatattcattttagtgtaaacttcaggttcatgatataagaataaatgagtgtcagaaagaattcagaactcaagaagggaaatatttgcaaaagattgaagactcttagcttatcggattagagctatctggagtgggctagggataaccaaattgttgatacttcttcagcttgtagaaaataaatatactggcaccttttcagaggcagggtgt

SEQ ID NO: 319254 - DNA, 662 bp, Homo sapiens
gcattgaaaaagttgggaaagaaaattggctacccagaagtcatacctggtaagtacaatcagaatggatagagaaaacagcttttgtccagttatctgtagctatttaaagccagctagaaattaaaaatgatatttagtagatttacagaatagcacagccatcatagcaatccagtttaagagcattttgttcacccctgtatgattccttacaactatttgcaatcaattccttttttcacatctgaattttttttctaatgtgggatttagagttattttaacttttctctgagggcagccaaagaaagttaggagacctactttctaacatcatgaccaccaatattctcatttgaaatctaattacatttctaaaaatgtagaaaactaaatctaatcctaatctgacagcaaatatattaatattttggaattcaacctaatgtcaacaatatttgaaccttattttgtgggatatattttagtggtcacatatggtccttcctggatatctgacctctttactgttttactaatgtctattcctttttgtttttatacataatgttttgtacatgcatgtagtgtttaagtaacaattttattgatatataatttacagattataaaactcaccttcttaaattatgcagttc

SEQ ID NO: 319255 - DNA, 6406 bp, Homo sapiens
aggcgcctgcgctttagctgctaactcgctctagtagctgtggtcggggctcgggaccggctgccatcttagtctagggactgaggagtcgccgccgccccgagtcccggtaccatgcatttcacggtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatatgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttcaaaaaaatgctt

SEQ ID NO: 319256 - DNA, 4304 bp, Homo sapiens
aggcgcctgcgctttagctgctaactcgctctagtagctgtggtcggggctcgggaccggctgccatcttagtctagggactgaggagtcgccgccgccccgagtcccggtaccatgcatttcacggtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatatgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaattttgcctttccaaattttttttgggggggcccccaaaagtggcttttttggggt

SEQ ID NO: 319257 - DNA, 6333 bp, Homo sapiens
aggcgcctgcgctttagctgctaactcgctctagtagctgtggtcggggctcgggaccggctgccatcttagtctagggactgaggagtcgccgccgccccgagtcccggtaccatgcatttcacggtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatatgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttcaaaaaaatgctt

SEQ ID NO: 319258 - DNA, 4686 bp, Homo sapiens
  misc_feature (46)..(46): n is a, c, g, or t
tcccttgtaatccaagcagtcgaagaaaaacattgtttgaggattnctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatatgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttcaaaaaaatgctt

SEQ ID NO: 319259 - DNA, 4201 bp, Homo sapiens
aagttttttataattttttaaaatttatttttatactcagaatttaaagataagatctaaacttcctgataggttttttcatatttgtttgccagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatatgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttcaaaaaaatgctt

SEQ ID NO: 319260 - DNA, 2833 bp, Homo sapiens
aggcgcctgcgctttagctgctaactcgctctagtagctgtggtcggggctcgggaccggctgccatcttagtctagggactgaggagtcgccgccgccccgagtcccggtaccatgcatttcacggtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcaggtgagagtgctccttttcacatttcactttttgtttgactacagcacattgataattgcttactaatactaatggagagtatctccaaaaatagtatttgtctctgtactaatcaatatcctatgtaggcagtcatttttcatttctaaaaagtttttttttaagtgtttttaaaagagttttaaggataaaagtcatgcaggatcactcttttaaacatcaactctgtaatcactatgctgtataacatgtcattaaaaagaatctcaaatatatatgcagatattttcatggggaatattgtaaggtgtattaatccactttcctgctgctgataaagacatatccaagactgggcaatttataaaaaaaagaggtttaatggacttacagttccacgagggtggggaggcctcaccctcatggtggaaggcaaggaggggcaagtcacatcttacatggatggcagcaggcaaagagagagcttgtacagggaaaactcctgtttttaaaacctcatcatcggccaggca

SEQ ID NO: 319261 - DNA, 1911 bp, Homo sapiens
  misc_feature (1866)..(1866): n is a, c, g, or t
  misc_feature (1871)..(1871): n is a, c, g, or t
  misc_feature (1874)..(1874): n is a, c, g, or t
  misc_feature (1886)..(1886): n is a, c, g, or t
  misc_feature (1902)..(1902): n is a, c, g, or t
aggcgcctgcgctttagctgctaactcgctctagtagctgtggtcggggctcgggaccggctgccatcttagtctagggactgaggagtcgccgccgccccgagtcccggtaccatgcatttcacggtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagnatganaanggttctctcggntgtcacatgatagctnagtgtaacc

SEQ ID NO: 319262 - DNA, 644 bp, Homo sapiens
ggaaaggcaggatcctggtttcaaaatctcagaagtgttcctggactctgtgcttcctcccccacctctgaagctgctgggtctcctcccatcggggcaggcccactggggctccgcgagtcatcttagtggaagccctgggctcctaagctttcttcttcccaagtgtgtcccagcttcagcgctgattcttccctactgcctggtgtctgagcctctgtcttgacaggctgcctcggctcctgcccatcctgctttcatccccaggactgagctctgattgctggtgtccaacccacagagaggctgtgccacagctcgcccggtgctatgttggggctgaattgtgccttccccctgccaaccccccaaccccatttacatgttgtagtcctaacccctgcccagtacctcagaatgtgactggatctggagatagggtcgttaaagagctatttcagatatagtgaggtcatcagggtgagccctgatccaatctgactggtgtccttataagaagaggagatgaggacacccacagaggccctgtgaggacacagggagaagatgccatccacaagccaaggagagaggctcagaggaaacttgatcttggacttccagcctccagaatcttgagaaaa

SEQ ID NO: 319263 - DNA, 1326 bp, Homo sapiens
tattgtgctggtaaaaatgtttcatgggacagtgaattctgaatttcagtttagggtaccagaaatatatctgttcctgttatggtagtaatgagggatcccctttcttaaacctgcaaaaaagtagaacattttggttgggcgtggtggctcacacctgtaatcccagcactttgggaagccgaggcaggcggatcacctggggtcaggagtttgagaccagcctggccaacatggtgaaaccccgtctctactaaaaatacaaaaatagccaggcatgttggtgcacacctgtattcccagctacttaggaggctgaagcaggagaatcgcttgaacccgggaggtagaagttgcagtgagccgaattgagccactgcactctagcctgggtgacagagcgagactctgtctcaaaaaaaaaaaaaaaaattaaaaagagagggagaacattctaaacaactgatggaggttcttgtggccaggcaagtttcagtagagctgaggtagatggagttgcttgggaataaggaccatagagactaaaagaaaggtctaaggagcatattttgcagaggcccaagtccataataaactggaataacccttctttgccccaggttatttccatttccagatccggcactctagatactccttttattttctgggcctctaggatttatctcctgctttctttttcaatgctgtcacctattatttctgactaaggtttttctctttataaatccactctgagatggaattcttttttccctaaatcccttttgaaatatttctaacagatgacactaaatatgggaaagcatattgggaccaaaaatataccattctttgttcttctttcttcctttaaaaagttagttgccatgtttaaaaagaaaagtggacatgtgctcttctcctttctggtcctatcccttcctccccatcatatcctactgtagactggctctggggcagataaaaatcaaggaaagcaaggggaagtgaatttttgtagtattgggtgggctttcaagtataagggccttatatatgaaagttaagttagggtctactatgtatatgtgttcagtttttaaaattttagttaatttttttaaaaatttaggtttatgtctgggaaagaaataaagaagaagaagcatttgtttgggttgcgaattcgtgttcctcctgtgccaccaaatgtggctttcaaagcagagaaagaaccagagagagaagacagcacctacattggaggacagcaagaatattgctggagtgtggcgtgcagaaggggatgtgtgaaggagaatt

SEQ ID NO: 319264 - DNA, 604 bp, Homo sapiens
aacttttatagtaaatattaaaataattctaatgtattatttccctaggttaaagaatttttgaaaaatttaataactaataatacagtcccatttttgtggtgttttacagtttgtagttccttcataaacatatcgttggattaatgtaatgaacaagtaactagtgtaggatttaaacttcattttttataagtgagaaaataagccttgagaggttaaatggccctaggtcacataatagtcagtgaggacttggaattagaacttagatcttctgactaccaatcagttcacttttcctctgcatcacattgcctctatctagcacctgtatattactaattgatgaaattgtagtgcgttaaattgtttcttgatacttcacagctggcagacacaccaaaatctgaaagatatgagcatgttctggaggcattaaatgattacaagaccatgtaagttgatttattttatgtatccctatgagggagacatttagtaagtataaggaataatggcattgtttaagaattgtgggattgatgtacagaagaagtctataccattttaaactttataatgtcctattctattttagtta

SEQ ID NO: 319265 - DNA, 650 bp, Homo sapiens
aacttttatagtaaatattaaaataattctaatgtattatttccctaggttaaagaatttttgaaaaatttaataactaataatacagtcccatttttgtggtgttttacagtttgtagttccttcataaacatatcgttggattaatgtaatgaacaagtaactagtgtaggatttaaacttcattttttataagtgagaaaataagccttgagaggttaaatggccctaggtcacataatagtcagtgaggacttggaattagaacttagatcttctgactaccaatcagttcacttttcctctgcatcacattgcctctatctagcacctgtatattactaattgatgaaattgtagtgcgttaaattgtttcttgatacttcacagctggcagacacaccaaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagt

SEQ ID NO: 319266 - DNA, 3847 bp, Homo sapiens
gcaccgacggagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacatgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttcttttgtttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtatttttaaagagc

SEQ ID NO: 319267 - DNA, 3978 bp, Homo sapiens
tattgtgctggtaaaaatgtttcatgggacagtgaattctgaatttcagtttagggtaccagaaatatatctgttcctgttatggtagtaatgagggatcccctttcttaaacctgcaaaaaagtagaacattttggttgggcgtggtggctcacacctgtaatcccagcactttgggaagccgaggcaggcggatcacctggggtcaggagtttgagaccagcctggccaacatggtgaaaccccgtctctactaaaaatacaaaaatagccaggcatgttggtgcacacctgtattcccagctacttaggaggctgaagcaggagaatcgcttgaacccgggaggtagaagttgcagtgagccgaattgagccactgcactctagcctgggtgacagagcgagactctgtctcaaaaaaaaaaaaaaaaattaaaaagagagggagaacattctaaacaactgatggaggttcttgtggccaggcaagtttcagtagagctgaggtagatggagttgcttgggaataaggaccatagagactaaaagaaaggtctaaggagcatattttgcagaggcccaagtccataataaactggaataacccttctttgccccaggttatttccatttccagatccggcactctagatactccttttattttctgggcctctaggatttatctcctgctttctttttcaatgctgtcacctattatttctgactaaggtttttctctttataaatccactctgagatggaattcttttttccctaaatcccttttgaaatatttctaacagatgacactaaatatgggaaagcatattgggaccaaaaatataccattctttgttcttctttcttcctttaaaaagttagttgccatgtttaaaaagaaaagtggacatgtgctcttctcctttctggtcctatcccttcctccccatcatatcctactgtagactggctctggggcagataaaaatcaaggaaagcaaggggaagtgaatttttgtagtattgggtgggctttcaagtataagggccttatatatgaaagttaagttagggtctactatgtatatgtgttcagtttttaaaattttagttaatttttttaaaaatttaggtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacatgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttcttttgtttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtatttttaaagagc

SEQ ID NO: 319268 - DNA, 3436 bp, Homo sapiens
gcaccgacggagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacagagccactggaagtggggaaatggtctgtaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacatgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttcttttgtttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtatttttaaagagc

SEQ ID NO: 319269 - DNA, 2804 bp, Homo sapiens
gcaccgacggagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccaaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatgggtagatattttacattcttattttttttactttttttactctagatttcttttctttgtaaagtgttgattgaataattttttagcaattgaaagtgatgtaagttgtgtctatcagctttttgagaggtaatccatatgtagatcccaatagttgttaatattcatttgaaatatttttgctttctagagtacaaatgtatttttcatgtttgtgtggaaatttgctgtgtacacagagaaaaagtataccattgtttagaagctgtgctcgttaggctttttaatgcctctgctacacaagtgttctttgctttaggaagatatgatttttttttttctttttaagagacagattctcactctgttgcccaggctggagtgcggtggcacaatcatggctcattgcagcctcaaactcctggcttcaaacaatcctcccatgtcggcctctctagtggctgggactacagattgtgccaccacacctaagtaatgcttttttattttttgtagagatggttttgctaatttgcccaggctggtcttgaactcccgatctcaagtgatcctcctgtgttggccttctcaagtgctgggattacacgcctgagccactacagctggccaagatttgattaaaaaaaaaaaaaaaatcagacacctaaatccttttgtccataaaatgattttaaacttaagattttcatcaatagcagactcccctctgatatcttatttaatccagcccttcagaaggacaacgtttttgtttattgtttatttttttttgagatggagtctcgctctgtcacccaggctggagtacagtggcatgatatcgactcactgcaacctccgcctcctggattcaagcaattctggcacctcagcctctcatgtagctgggatttacaggcgtgcgccaccatgcccagctaactttttgtatttttaatagagatggggtttcaccatgttggccaggcaggtcttgaactcctaatctcaagtgatccacctgcctcggcctcccaaagtgccgggattacaggcgtgagccactttgcctggccaggacaacttttctctaaagcacatcatgtcaggtatgaaaaggttaatct

SEQ ID NO: 319270 - DNA, 2412 bp, Homo sapiens
gcagtataccggaaacagctatacaggaaacaggtatgactaggcagagtgtatgaccaggataagacggtataagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacatgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttcttttgtttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtatttttaaagagc

SEQ ID NO: 319271 - DNA, 1924 bp, Homo sapiens
gcaccgacggagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtggtaagtgtggacctttctgttaaaagaaagaaaagccattttcttaaacctacaagttgaaactttctatatacatttacttggcttaagtaaaaataggttatttatgcttggctttatttcttttatttatcctcatgcctgatgtcatcttcactaagtaacatccacttgtattgctaaattaataaggctgttcagtgttgaatgttataaatgaaactttcagatatcctttagacctaaattcttactcatatttctagttcttttgaacattcagaataccatacagtagaagagagataggtataacaaatatgctaatttctgcttcaatgtagtaattcttgtgtgttggaagtgtgatgaattttagaggtttactaataaaatgcttacagtaagtacttacaaatctttgttgtattttacatattttatcaacagataggatttaacccatgaatcaaatagtttggttaagtatggtatattctgtagcttatatccggaagtgaaaacacaaaaatcttgattttaagttatatttttttaaagccagaccctctttgaatgcacttgaagaagtaatttgtggccaggtgcggtggctttcgcctgtaatcccagcactttgggaggccgaggtgggtggatctcctgaggtctggagtttaagaccagcctggccaacacggtgaaaccacgtttctactaaaaatacaaaaaaatttagcctagcgtggtggtgggcgcctgtaatcccagctactcgggaggctgagggaggctgaggcaggagaatcgcttgaacccacggggcggaagttgcagtgagctgacgttgtgccattgtactactccagcctg

SEQ ID NO: 319272 - DNA, 1311 bp, Homo sapiens
gcaccgacggagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgctggcagacacaccaaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagt

SEQ ID NO: 319273 - DNA, 4086 bp, Homo sapiens
gcaccgacggagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccaaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacatgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttcttttgtttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtatttttaaagagc

SEQ ID NO: 319274 - DNA, 3915 bp, Homo sapiens
gcaccgacggagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccaaaatctgaaagatatgagcatgttctggaggcattaaatgattacaagaccatggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacatgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttcttttgtttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtatttttaaagagc

SEQ ID NO: 319275 - DNA, 4184 bp, Homo sapiens
gcaccgacggagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagttctggggacaaataagtttggtatggatatcaggaccagccttctcatcctcctgtgtgttgttgcctgttgactctggaaattgtagaaggaggagctggcagacacaccaaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacatgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttcttttgtttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtatttttaaagagc

SEQ ID NO: 319276 - DNA, 3991 bp, Homo sapiens
gcaccgacggagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccaaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacatgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttcttttgtttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtatttttaaagagc

SEQ ID NO: 319277 - DNA, 3805 bp, Homo sapiens
gcaccgacggagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccaaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacatgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttcttttgtttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtatttttaaagagc

SEQ ID NO: 319278 - DNA, 3126 bp, Homo sapiens
ttcttttttttttttttcttagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccaaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgcggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaaggagtctggcttttactatctttcttaaaaaaaaaaaaaagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgctctgtgactagacttcattgtcgtcttaatatattcttgcatgtgcatatatatacacacatgtgtatatatatgtgtgtgattatgtgacctatgcaatacaaattatgggaatgggcagctttggagtatatatcccataattcttttttcaggaatagttgcagtatttacacagcagcatttcttctcaggcttttattgggtgctgttgcttgctatgtatgaagagaaatgtgtcagacaagtttagtgtgttctgaagaagggtgtgaacaacagtgttcatgggcttttagaatgcttttcacttttagtccttgtaactcagctgttcagtacctaaaacaaattcaaataatatgaacattatctcctactagaagtaacgttttcaagttttcatggcacattatgattgtaaatgtctctcatttttaacagtaagtctataggagtcccgtgaagattcctgaaatgtctgtagtaactgttagtcatgtttgaataagtgtagtatgaacaaagtattttattgcacagggttaacaaacagtatgttgccagctgaggctactgctgttttattacaacattacctcttgtttttataaagtgtaccaagatttaaattgataactttattttacttgtaaaaaaaaagtttcttttatcaccagtgttacagttgtcttctgtttcttttgtttgttttatttgttttcctttttagccaaagagtgaacagaagattttcttattttggtggctattcattttacttttaaaagtgattggtggattttagactaattatgggggaatttgccaccaaaataaaaaatatgtaaagtgtagtgattacagagtggttaaaatgtgggttagtacttatttattccattaattgattatttgactgtttataaagaaagttgctttatttctttaaacatcttcaaaagatgatcctttcttgtcacattatagccaaaagaagcagagaacttcattgtctgcatttggttcctggttggccaggtataaatgagctttacaaaagtgcaaattaaaaactgttacttctgtttacctccaccaaaacttgattttcccctagctattaatttaaggttgcctttcctgcagctgcaatattttgaataacacacagagtttgtgttgatttttgaatgtttgtttatatctaggggtaatgaaaaatgtaaatcccgtgtatccttattcactccacctgtatcatattatttcattttccccaaagtcctttaattctaactgaacaccagcagtatttttagaaatttttctttaacatacttggaagatgatttatccagctgaactgtctttagacgtaattattgtgaatgtctgttttattttctcatggtggttcacatggctctgatgttcagtttgtatttttggaattgctttacttagaaattaaaacagaccaacattaaatgtgtgtatttttaaagagc

SEQ ID NO: 319279 - DNA, 2902 bp, Homo sapiens
gcaccgacggagtccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagttctggggacaaataagtttggtatggatatcaggaccagccttctcatcctcctgtgtgttgttgcctgttgactctggaaattgtagaaggaggagctggcagacacaccaaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatgggtagatattttacattcttattttttttactttttttactctagatttcttttctttgtaaagtgttgattgaataattttttagcaattgaaagtgatgtaagttgtgtctatcagctttttgagaggtaatccatatgtagatcccaatagttgttaatattcatttgaaatatttttgctttctagagtacaaatgtatttttcatgtttgtgtggaaatttgctgtgtacacagagaaaaagtataccattgtttagaagctgtgctcgttaggctttttaatgcctctgctacacaagtgttctttgctttaggaagatatgatttttttttttctttttaagagacagattctcactctgttgcccaggctggagtgcggtggcacaatcatggctcattgcagcctcaaactcctggcttcaaacaatcctcccatgtcggcctctctagtggctgggactacagattgtgccaccacacctaagtaatgcttttttattttttgtagagatggttttgctaatttgcccaggctggtcttgaactcccgatctcaagtgatcctcctgtgttggccttctcaagtgctgggattacacgcctgagccactacagctggccaagatttgattaaaaaaaaaaaaaaaatcagacacctaaatccttttgtccataaaatgattttaaacttaagattttcatcaatagcagactcccctctgatatcttatttaatccagcccttcagaaggacaacgtttttgtttattgtttatttttttttgagatggagtctcgctctgtcacccaggctggagtacagtggcatgatatcgactcactgcaacctccgcctcctggattcaagcaattctggcacctcagcctctcatgtagctgggatttacaggcgtgcgccaccatgcccagctaactttttgtatttttaatagagatggggtttcaccatgttggccaggcaggtcttgaactcctaatctcaagtgatccacctgcctcggcctcccaaagtgccgggattacaggcgtgagccactttgcctggccaggacaacttttctctaaagcacatcatgtcaggtatgaaaaggttaatct

SEQ ID NO: 319280 - DNA, 1785 bp, Homo sapiens
gataagcttgatatcgacttcgtgttcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtatctcttgctcctcctcctccctccatcctacaggtaactcctcagttacctttaatgggatttgtggccagagtccaagaaaatatttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggt

SEQ ID NO: 319281 - DNA, 399 bp, Homo sapiens
ctgtgaggcaagcacagccctgatgagctttactcagaataatgcatgatagactcaacgtaattcccaggaaaaagcccagtcactccattcataactccctcataccaaccatcgtcattgtggcaatttatgactatacaaaagacaaggaagatgagctgtcctttcaggaaggagccattatttatgtcatcaagaagaatgacgatggttggtatgagggagttatgaatggagtgacataaataatggctccttcctgaaaggaatcttccttgtcttttgtatagtcataaattgccacaaccttttccaagtaagaacgtggagcccacggtgggtcctcttcagcataaggatcactatactcaaccacagcagcttcctcctcttcgt

SEQ ID NO: 319282 - DNA, 2710 bp, Homo sapiens
  misc_feature (28)..(28): n is a, c, g, or t
gagcgcgcgtgcgcgcgcccggccggcngtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagagagggcaagaacaaatattagacaccatggctattgtggacatgtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtata

SEQ ID NO: 319283 - DNA, 2752 bp, Homo sapiens
  misc_feature (28)..(28): n is a, c, g, or t
gagcgcgcgtgcgcgcgcccggccggcngtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtatctcttgctcctcctcctccctccatcctacaggtaactcctcagttacctttaatgggatttgtggccagagtccaagaaaatatttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtata

SEQ ID NO: 319284 - DNA, 2848 bp, Homo sapiens
  misc_feature (28)..(28): n is a, c, g, or t
gagcgcgcgtgcgcgcgcccggccggcngtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccagcccctgctggctctgctggcactcctccccttcctgctacttctgcatctgcccctgctcctcttgttcctgctactgtcccttcctccactgccccagacgctgctgctgggggtgcccagacccttgctgatggcttcacttctccaactccccctgttgtttcttccactccccctacaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtata

SEQ ID NO: 319285 - DNA, 2623 bp, Homo sapiens
  misc_feature (28)..(28): n is a, c, g, or t
gagcgcgcgtgcgcgcgcccggccggcngtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaagtggttgcttagatttaaggtgagtacccagaacatgaagatgggtgggctgccgcgtacaacacctccaactcagaagccccctagtccccctatgtcagggaaagggacacttggcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtatctcttgctcctcctcctccctccatcctacaggtaactcctcagttacctttaatgggatttgtggccagagtccaagaaaatatttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtata

SEQ ID NO: 319286 - DNA, 4021 bp, Homo sapiens
  misc_feature (28)..(28): n is a, c, g, or t
gagcgcgcgtgcgcgcgcccggccggcngtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtatctcttgctcctcctcctccctccatcctacaggtaactcctcagttacctttaatgggatttgtggccagagtccaagaaaatatttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagacagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaatataactgacacaataaaacacatttcccccatctgtacaataaatacagcttcaaattcagtggagtctgtagggcagataactttaatcatcactactgtagtcagtataagaaatgctgaaaaaaatccaggagggcttgtctctttgtgggtggtcactgtgatgttgggccagctcctgttcaggtccagagctgctaacgtgggttctactcagtcccagtgacttggccagaatagagctttgccaggtaactgccctgtgctaggtgaaaggggaaaagcagtagctggatatatttcaaatgaggttttgaacaagttcagaaagtggaacttgattgaaaagtgaacaagtgtagtagtgtgtgagaaaattcagatggtgtcggatgcagaagttaatattccacttaatgttatctgagcattaaaaatcatcagcatttaactgagaccccactatagagtttccttatcaagactttttggttttaaagttgtttttaatgcattgcaagttacaatagctattttgcttttagatttttcccagcactttgtatttattagctttcattaacttgcctccagtatacattccacttcgtgcttttcttaggtcatttctacatcccttattccttgttttcctgcagtgtaatggccctgaatgtcctctgagccttcagctccattatggacccaaactagactatacttggataagttaagctcttcttcgtgtactggtctataattagaaaaactgttttaaattagatgttcccattatttatttaaacagctttttgctgagaaagcttagtggattaatgaggcagagggtgttttgaaatccaataaatagttcccacaggctgggtgtggtggcttatgcctgtaatcccagcactttcggaggccgaggtgggtggatcatgaggtcaataaattgagaccatcctggccaacatggtgaaaccccatctctactaaaaacacaaaaattagctgggcgtggtggcgcacacctgtagtcccagctacttgggaggctgaggcaggagaatcactggaacctgggaggcggaggttgcagtgagccgagattgtgccactgcactccagcctggtgacagagcgagactccatcaaaaaaa

SEQ ID NO: 319287 - DNA, 2269 bp, Homo sapiens
aagtcctttatactgaagacctgtggttgggagcaggggtagtccatgggtctgctgattttttttccctatttagtactaatgtgtgtgtgatctttgttttacaaacagtaccttttgggttttctgcatattttataatttttgtacagttttgaattctatagattgtcttggaaggatactgtgtgatgggtcaggcacacagtaattggagacttttaatgtatgtaatatttcatagattgcatgctattaatcatctgtgagggtagtattttttgttttattgtaagtttccctctttttttataaattaaaagatggttggtattaggaatttcaaatgaatgcagaaaatcttacatgctgtgtactattaatattataacagacgatccaagtccaaaatctgaccaataaagcaaccattttatcaagatagagggattctaatgggagaggggattcttccctcctgaagtttgtgtgtccagtccccttaaaaaaaatgaatagttgtcttttcttgtcatattaatactcgaaagtccatggtggtattaatgaaagtacactttattgttgcctttgaacttacggccaaggcaataaatcagaaacaaaaatagtgccaatgtgtcaaaatcgacatctgagagattcagcctcccatttggaataaatatgaatcttctaagctatcttgtttaatattttccatcatttagctacttcctatctccctcagaggcgcctgctgttcccattttagagttgacagtggcctgctaattttgctatgttcctaaaagttactgggtgtgagacattttcatcccctcctttttcctactgctggtgtttattatccagctagacaatattttatgcatatttaccgtgatgtctggaccgtacctgtgctccttggcagtttatgttgaagataactaaagatttttctctttgggaggcatcaaaatgatggtagtttgcttttatctttttatgttcattttcttttagtaggtgacctttctgcattaagaactgtttttatcttttactaccttttcttttctcctttgtggagacagcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtata

SEQ ID NO: 319288 - DNA, 4021 bp, Homo sapiens
  misc_feature (28)..(28): n is a, c, g, or t
gagcgcgcgtgcgcgcgcccggccggcngtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtatctcttgctcctcctcctccctccatcctacaggtaactcctcagttacctttaatgggatttgtggccagagtccaagaaaatatttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaatataactgacacaataaaacacatttcccccatctgtacaataaatacagcttcaaattcagtggagtctgtagggcagataactttaatcatcactactgtagtcagtataagaaatgctgaaaaaaatccaggagggcttgtctctttgtgggtggtcactgtgatgttgggccagctcctgttcaggtccagagctgctaacgtgggttctactcagtcccagtgacttggccagaatagagctttgccaggtaactgccctgtgctaggtgaaaggggaaaagcagtagctggatatatttcaaatgaggttttgaacaagttcagaaagtggaacttgattgaaaagtgaacaagtgtagtagtgtgtgagaaaattcagatggtgtcggatgcagaagttaatattccacttaatgttatctgagcattttttggttttaaagttgtttttaatgcattgcaagttacaatagctattttgcttttagatttttcccagcactttgtatttattagctttcattaacttgcctccagtatacattccacttcgtgcttttcttaggtcatttctacatcccttattccttgttttcctgcagtgtaatggccctgaatgtcctctgagccttcagctccattatggacccaaactagactatacttggataagttaagctcttcttcgtgtactggtctataattagaaaaactgttttaaattagatgttcccattatttatttaaacagctttttgctgagaaagcttagtggattaatgaggcagagggtgttttgaaatccaataaatagttcccacaggctgggtgtggtggcttatgcctgtaatcccagcactttcggaggccgaggtgggtggatcatgaggtcaataaattgagaccatcctggccaacatggtgaaaccccatctctactaaaaacacaaaaattagctgggcgtggtggcgcacacctgtagtcccagctacttgggaggctgaggcaggagaatcactggaacctgggaggcggaggttgcagtgagccgagattgtgccactgcactccagcctggtgacagagcgagactccatcaaaaaaa

SEQ ID NO: 319289 - DNA, 2617 bp, Homo sapiens
  misc_feature (236)..(236): n is a, c, g, or t
gataagcttgatatcgacttcgtgttcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagngccctagaagaaaccaaagcctacaccaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtata

SEQ ID NO: 319290 - DNA, 2497 bp, Homo sapiens
  misc_feature (28)..(28): n is a, c, g, or t
gagcgcgcgtgcgcgcgcccggccggcngtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtata

SEQ ID NO: 319291 - DNA, 2804 bp, Homo sapiens
gataagcttgatatcgacttcgtgttcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaagcaaattagaggcgttgatcttgagtcgacttttgtgaccaaatttggaaacaattgcagtttgagattgaatgagacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaagtggttgcttagatttaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccagcccctgctggctctgctggcactcctccccttcctgctacttctgcatctgcccctgctcctcttgttcctgctactgtcccttcctccactgccccagacgctgctgctgggggtgcccagacccttgctgatggcttcacttctccaactccccctgttgtttcttccactccccctacaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtata

SEQ ID NO: 319292 - DNA, 3926 bp, Homo sapiens
gataagcttgatatcgacttcgtgttcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaagcaaattagaggcgttgatcttgagtcgacttttgtgaccaaatttggaaacaattgcagtttgagattgaatgagacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaatataactgacacaataaaacacatttcccccatctgtacaataaatacagcttcaaattcagtggagtctgtagggcagataactttaatcatcactactgtagtcagtataagaaatgctgaaaaaaatccaggagggcttgtctctttgtgggtggtcactgtgatgttgggccagctcctgttcaggtccagagctgctaacgtgggttctactcagtcccagtgacttggccagaatagagctttgccaggtaactgccctgtgctaggtgaaaggggaaaagcagtagctggatatatttcaaatgaggttttgaacaagttcagaaagtggaacttgattgaaaagtgaacaagtgtagtagtgtgtgagaaaattcagatggtgtcggatgcagaagttaatattccacttaatgttatctgagcattaaaaatcatcagcatttaactgagaccccactatagagtttccttatcaagactttttggttttaaagttgtttttaatgcattgcaagttacaatagctattttgcttttagatttttcccagcactttgtatttattagctttcattaacttgcctccagtatacattccacttcgtgcttttcttaggtcatttctacatcccttattccttgttttcctgcagtgtaatggccctgaatgtcctctgagccttcagctccattatggacccaaactagactatacttggataagttaagctcttcttcgtgtactggtctataattagaaaaactgttttaaattagatgttcccattatttatttaaacagctttttgctgagaaagcttagtggattaatgaggcagagggtgttttgaaatccaataaatagttcccacaggctgggtgtggtggcttatgcctgtaatcccagcactttcggaggccgaggtgggtggatcatgaggtcaataaattgagaccatcctggccaacatggtgaaaccccatctctactaaaaacacaaaaattagctgggcgtggtggcgcacacctgtagtcccagctacttgggaggctgaggcaggagaatcactggaacctgggaggcggaggttgcagtgagccgagattgtgccactgcactccagcctggtgacagagcgagactccatcaaaaaaa

SEQ ID NO: 319293 - DNA, 1696 bp, Homo sapiens
  misc_feature (28)..(28): n is a, c, g, or t
gagcgcgcgtgcgcgcgcccggccggcngtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtatctcttgctcctcctcctccctccatcctacaggtaactcctcagttacctttaatgggatttgtggccagagtccaagaaaatatttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgattattaaaaacaaagcaagctgagtctgaacaaatggatctttctgccatcatttgtacaatgctgagctgtctggattgaaataaaatgaccatttttatgtatgtcaaaggt

SEQ ID NO: 319294 - DNA, 1590 bp, Homo sapiens
  misc_feature (28)..(28): n is a, c, g, or t
gagcgcgcgtgcgcgcgcccggccggcngtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagttcagatacacaaactcacggcactgttgaagaaccagctttgatgagttacgcaaatactcatctcagaagataggaaaggaggaagtgatgggtgagcataagaactatgcataacaggaccacgagggacacagtctaacgggaaagcttgtgcaattatgactagaaaaaaaaggagaaaaaagacattaagaagggaaaatgatgaaaagaaaaaaaaaggtgtacagagataaaggagaagaggaacggaaagaagataaggtaagaaaaaagagaggataaaagaacaaaataaggagaaaaaatgaaaaagtagctagaaagaagatatgtgtttttagactggaggacaag

SEQ ID NO: 319295 - DNA, 2297 bp, Homo sapiens
  misc_feature (28)..(28): n is a, c, g, or t
gagcgcgcgtgcgcgcgcccggccggcngtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaatataactgacacaataaaacacatttcccccatctgtacaataaatacagcttcaaattcagtggagtctgtagggcagataactttaatcatcactactgtagtcagtataagaaatgctgaaaaaaatccaggagggcttgtctctttgtgggtggtcactgtgatgttgggccagctcctgttcaggtccagagctgctaacgtgggttctactcagtcccagtgacttggccagaatagagctttgccaggtaactgccctgtgctaggtgaaaggggaaaagcagtagctggatatatttcaaatgaggttttgaacaagttcagaaagtggaacttgattgaaaagtgaacaagtgtagtagtgtgtgagaaaattcagatggtgtcggatgcagaagttaatattccacttaatgttatctgagcattaaaaatcatcagcatttaactgagaccccactatagagtttccttatcaagactttttggttttaaagttgtttttaatgcattgcaagttacaatagctattttgcttttagatttttcccagcactttgtatttattagctttcattaacttgcctccagtatacattccacttcgtgcttttcttaggtcatttctacatcccttattccttgttttcctgcagtgtaatggccctgaatgtcctctgagccttcagctccattatggacccaaactagactatacttggataagttaagctcttcttcgtgtactggtctataattagaaaaactgttttaaattagatgttcccattatttatttaaacagctttttgctgagaaagcttagtggattaatgaggcagagggtgttttgaaatccaataaatagttcccacaggctgggtgtggtggcttatgcctgtaatcccagcactttcggaggccgaggtgggtggatcatgaggtcaataaattgagaccatcctggccaacatggtgaaaccccatctctactaaaaacacaaaaattagctgggcgtggtggcgcacacctgtagtcccagctacttgggaggctgaggcaggagaatcactggaacctgggaggcggaggttgcagtgagccgagattgtgccactgcactccagcctggtgacagagcgagactccatcaaaaaaa

SEQ ID NO: 319296 - DNA, 919 bp, Homo sapiens
aagtcctttatactgaagacctgtggttgggagcaggggtagtccatgggtctgctgattttttttccctatttagtactaatgtgtgtgtgatctttgttttacaaacagtaccttttgggttttctgcatattttataatttttgtacagttttgaattctatagattgtcttggaaggatactgtgtgatgggtcaggcacacagtaattggagacttttaatgtatgtaatatttcatagattgcatgctattaatcatctgtgagggtagtattttttgttttattgtaagtttccctctttttttataaattaaaagatggttggtattaggaatttcaaatgaatgcagaaaatcttacatgctgtgtactattaatattataacagacgatccaagtccaaaatctgaccaataaagcaaccattttatcaagatagagggattctaatgggagaggggattcttccctcctgaagtttgtgtgtccagtccccttaaaaaaaatgaatagttgtcttttcttgtcatattaatactcgaaagtccatggtggtattaatgaaagtacactttattgttgcctttgaacttacggccaaggcaataaatcagaaacaaaaatagtgccaatgtgtcaaaatcgacatctgagagattcagcctcccatttggaataaatatgaatcttctaagctatcttgtttaatattttccatcatttagctacttcctatctccctcagaggcgcctgctgttcccattttagagttgacagtggcctgctaattttgctatgttcctaaaagttactgggtgtgagacattttcatcccctcctttttcctactgctggtgtttattatccagctaggtcgacgcggccgcgaatttagtagtagtaggcggccgc

SEQ ID NO: 319297 - DNA, 500 bp, Homo sapiens
tttcaattctttaaaaaaaaatcagtatgtgatttccacgtaaagtcatacaacttagtttttctgagcagaatttttttgaatattttagtggttatttgctttttaaaataacattgtggtgaatggtatttcctttttatttaatcagacatccttacttttaaataacaaataatgaaagttgtgtgcacatgaacagaatttagaagtggcaaaggaaaagagaacatttttgaagctactttgtgctagggaattatactagcttatacaattctcataccaaacccatggtggaaaaactaggaattgggtaaattgaatcagatataataattacactaaataatcggttgtatcatgcatgcagaataactaatctggaacatatttaataattattattttgtttactccccagagagggcaagaacaaatattagacaccatggctattgtggacatggtatgtcaacttactgcttttttctgtattt

SEQ ID NO: 319298 - DNA, 445 bp, Homo sapiens
ataattttttcaaaatgtggtcaaaacaagcttattgaactcagttttcccctcaactttattaataagtaaatatatatatatatatacacacacacacacacacacacacacacacacacacatttttttttaacctgtcactgacttggagctcaaggaaattttattttgaagtggtacgcttttgaattacctttattgtagctacattcatctcagaaaatgtcgggaagtgctgatgatctcttactgtttataaatactcatgttttggtggctcttatttctttagcagcagtgggagtagtggagggagccacccaagtagtcggagcagcagtcgagagaacagtggaagtggtagtgtgggggttcctattgctgttcctactccatctcctcccagtgtctttccaggtaaaacattcatggtgcctcgtct

SEQ ID NO: 319299 - DNA, 2374 bp, Homo sapiens
cgggccccattgtgttgtggtaaatatgtagagggagtatagggctgtgactagtatgttgagtcctgtaagtaggagagtgatatttgatcaggagaacgtggttgcttagatttaaggtgagtacccagaacatgaagatgggtgggctgccgcgtacaacacctccaactcagaagccccctagtccccctatgtcagggaaagggacacttggcagcagtgggagtagtggagggagccacccaagtagtcggagcagcagtcgagagaacagtggaagtggtagtgtgggggttcctattgctgttcctactccatctcctcccagtgtctttccagcccctgctggctctgctggcactcctccccttcctgctacttctgcatctgcccctgctcctcttgttcctgctactgtcccttcctccactgccccagacgctgctgctgggggtgcccagacccttgctgatggcttcacttctccaactccccctgttgtttcttccactccccctacaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaatataactgacacaattatcaacataaaaccccctgccataacccaataccaaacgcccctcttcgtctgatccgtcctaatcacagcagtcctacccg

SEQ ID NO: 319300 - DNA, 2665 bp, Homo sapiens
  misc_feature (28)..(28): n is a, c, g, or t
gagcgcgcgtgcgcgcgcccggccggcngtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtata

SEQ ID NO: 319301 - DNA, 2942 bp, Homo sapiens
  misc_feature (28)..(28): n is a, c, g, or t
gagcgcgcgtgcgcgcgcccggccggcngtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtataaaaaaaaaaaaaaaaaaaaaaaaaaaaaaaaaaaaaaaaaaaaaaaagcaaaaaagaaaaaacaaaaagaaagagaaacaacaacacaacaaacgagacagaacacaccagacagcagcaccacaagcgcgcagaggcgagacagcacgagcagagcgaagcaaccatgcgagggcgcacagcgagtacgcgacgcagaagccagggggtcagccacagccgcagcccagtggtaaacgcgacacccgccgcacgcgcgttcgaccgacgcccaggc

SEQ ID NO: 319302 - DNA, 2605 bp, Homo sapiens
  misc_feature (28)..(28): n is a, c, g, or t
gagcgcgcgtgcgcgcgcccggccggcngtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttggcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtatctcttgctcctcctcctccctccatcctacaggtaactcctcagttacctttaatgggatttgtggccagagtccaagaaaatatttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtata

SEQ ID NO: 319303 - DNA, 4075 bp, Homo sapiens
  misc_feature (28)..(28): n is a, c, g, or t
gagcgcgcgtgcgcgcgcccggccggcngtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtatctcttgctcctcctcctccctccatcctacaggtaactcctcagttacctttaatgggatttgtggccagagtccaagaaaatatttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaatataactgacacaataaaacacatttcccccatctgtacaataaatacagcttcaaattcagtggagtctgtagggcagataactttaatcatcactactgtagtcagtataagaaatgctgaaaaaaatccaggagggcttgtctctttgtgggtggtcactgtgatgttgggccagctcctgttcaggtccagagctgctaacgtgggttctactcagtcccagtgacttggccagaatagagctttgccaggtaactgccctgtgctaggtgaaaggggaaaagcagtagctggatatatttcaaatgaggttttgaacaagttcagaaagtggaacttgattgaaaagtgaacaagtgtagtagtgtgtgagaaaattcagatggtgtcggatgcagaagttaatattccacttaatgttatctgagcattaaaaatcatcagcatttaactgagaccccactatagagtttccttatcaagactttttggttttaaagttgtttttaatgcattgcaagttacaatagctattttgcttttagatttttcccagcactttgtatttattagctttcattaacttgcctccagtatacattccacttcgtgcttttcttaggtcatttctacatcccttattccttgttttcctgcagtgtaatggccctgaatgtcctctgagccttcagctccattatggacccaaactagactatacttggataagttaagctcttcttcgtgtactggtctataattagaaaaactgttttaaattagatgttcccattatttatttaaacagctttttgctgagaaagcttagtggattaatgaggcagagggtgttttgaaatccaataaatagttcccacaggctgggtgtggtggcttatgcctgtaatcccagcactttcggaggccgaggtgggtggatcatgaggtcaataaattgagaccatcctggccaacatggtgaaaccccatctctactaaaaacacaaaaattagctgggcgtggtggcgcacacctgtagtcccagctacttgggaggctgaggcaggagaatcactggaacctgggaggcggaggttgcagtgagccgagattgtgccactgcactccagcctggtgacagagcgagactccatcaaaaaaa

SEQ ID NO: 319304 - DNA, 3827 bp, Homo sapiens
  misc_feature (28)..(28): n is a, c, g, or t
gagcgcgcgtgcgcgcgcccggccggcngtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtatctcttgctcctcctcctccctccatcctacaggtaactcctcagttacctttaatgggatttgtggccagagtccaagaaaatatttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaatataactgacacaataaaacacatttcccccatctgtacaataaatacagcttcaaattcagtggagtctgtagggcagataactttaatcatcactactgtagtcagtataagaaatgctgaaaaaaatccaggagggcttgtctctttgtgggtggtcactgtgatgttgggccagctcctgttcaggtccagagctgctaacgtgggttctactcagtcccagtgacttggccagaatagagctttgccaggtaactgccctgtgctaggtgaaaggggaaaagcagtagctggatatatttcaaatgaggttttgaacaagttcagaaagtggaacttgattgaaaagtgaacaagtgtagtagtgtgtgagaaaattcagatggtgtcggatgcagaagttaatattccacttaatgttatctgagcattaaaaatcatcagcatttaactgagaccccactatagagtttccttatcaagactttttggttttaaagttgtttttaatgcattgcaagttacaatagctattttgcttttagatttttcccagcactttgtatttattagctttcattaacttgcctccagtatacattccacttcgtgcttttcttaggtcatttctacatcccttattccttgttttcctgcagtgtaatggccctgaatgtcctctgagccttcagctccattatggacccaaactagactatacttggataagttaagctcttcttcgtgtactggtctataattagaaaaactgttttaaattagatgttcccattatttatttaaacagctttttgctgagaaagcttagtggattaatgaggcggaggttgcagtgagccgagattgtgccactgcactccagcctggtgacagagcgagactccatcaaaaaaa

SEQ ID NO: 319305 - DNA, 2016 bp, Homo sapiens
cggtaccggtgttatcgagtgccaccccgccctagtccctatgtcagtgaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtatctcttgctcctcctcctccctccatcctacaggtaactcctcagttacctttaatgggatttgtggccagagtccaagaaaatatttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaaaagaatgtaaacaatttgtgatctggccagttgtacttttagctcccagagggagagttggtggtattatgagttgagtaaaaaccatccaggggaacttgagggagcagtctgttgccagtaatgttccttgtgtgccattaaaccacctccagatgagtggaggaacatcactttttaattttttaattgtatttggaattgttgccgtgtactaagaacttgacctaaataaaatcccacaaagtata

SEQ ID NO: 319306 - DNA, 4189 bp, Homo sapiens
  misc_feature (28)..(28): n is a, c, g, or t
gagcgcgcgtgcgcgcgcccggccggcngtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaagtggttgcttagatttaaggtgagtacccagaacatgaagatgggtgggctgccgcgtacaacacctccaactcagaagccccctagtccccctatgtcagggaaagggacacttgggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacagcagcagtgggagtagtggagggagccacccaagtagtcggagcagcagtcgagagaacagtggaagtggtagtgtgggggttcctattgctgttcctactccatctcctcccagtgtctttccagcccctgctggctctgctggcactcctccccttcctgctacttctgcatctgcccctgctcctcttgttcctgctactgtcccttcctccactgccccagacgctgctgctgggggtgcccagacccttgctgatggcttcacttctccaactccccctgttgtttcttccactccccctacaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtattagttgctgctgtattactgactcgcttagctgtagaaagggtaatactctcctgattttgtatgattggactcttaagtagctgctgttagtcagaattaaaacccatctcagactaagaatataatgaataagattaataggccaaaatatgtatctaatcacattgataaaaattaatataactgacacaataaaacacatttcccccatctgtacaataaatacagcttcaaattcagtggagtctgtagggcagataactttaatcatcactactgtagtcagtataagaaatgctgaaaaaaatccaggagggcttgtctctttgtgggtggtcactgtgatgttgggccagctcctgttcaggtccagagctgctaacgtgggttctactcagtcccagtgacttggccagaatagagctttgccaggtaactgccctgtgctaggtgaaaggggaaaagcagtagctggatatatttcaaatgaggttttgaacaagttcagaaagtggaacttgattgaaaagtgaacaagtgtagtagtgtgtgagaaaattcagatggtgtcggatgcagaagttaatattccacttaatgttatctgagcattaaaaatcatcagcatttaactgagaccccactatagagtttccttatcaagactttttggttttaaagttgtttttaatgcattgcaagttacaatagctattttgcttttagatttttcccagcactttgtatttattagctttcattaacttgcctccagtatacattccacttcgtgcttttcttaggtcatttctacatcccttattccttgttttcctgcagtgtaatggccctgaatgtcctctgagccttcagctccattatggacccaaactagactatacttggataagttaagctcttcttcgtgtactggtctataattagaaaaactgttttaaattagatgttcccattatttatttaaacagctttttgctgagaaagcttagtggattaatgaggcagagggtgttttgaaatccaataaatagttcccacaggctgggtgtggtggcttatgcctgtaatcccagcactttcggaggccgaggtgggtggatcatgaggtcaataaattgagaccatcctggccaacatggtgaaaccccatctctactaaaaacacaaaaattagctgggcgtggtggcgcacacctgtagtcccagctacttgggaggctgaggcaggagaatcactggaacctgggaggcggaggttgcagtgagccgagattgtgccactgcactccagcctggtgacagagcgagactccatcaaaaaaa

SEQ ID NO: 319307 - DNA, 1377 bp, Homo sapiens
  misc_feature (28)..(28): n is a, c, g, or t
  misc_feature (1350)..(1350): n is a, c, g, or t
gagcgcgcgtgcgcgcgcccggccggcngtcgccgcggtgaccgtcctcggagtccgtcggctcgcgccccgcccccgtcgccccctcccctgtcgcgcgctggggctgtttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaaacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtgagtacccagaacatgaagatgggtgggctgccgcgtacaacacctccaactcagaagccccctagtccccctatgtcagggaaagggacacttggcagcagtgggagtagtggagggagccacccaagtagtcggagcagcagtcgagagaacagtggaagtggtagtgtgggggttcctattgctgttcctactccatctcctcccagtgtctttccaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaaggttgtggcaatttatgactatacaaaagacaaggaagatgagctgtcctttcaggaaggagccattatttatgtcatcaagaagaatgacgatncaagagtgaaacaatgaatcaaaaaag

SEQ ID NO: 319308 - DNA, 762 bp, Homo sapiens
gataagcttgatatcgacttcgtgttcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaagtgagaccacaatattttcctatttgcctatgaggaacccttaataataaacacaggctatctgtaatgctggcagcttttattatgtaagttaactcacatgtacgatttggaaaatagcaacttaatattaggttgtttttagattctgtctttttgtgggatggttatcttctctgtgattttgataggaaagtaaatcgtaatgaattttattaaaactcagttgtcatggtaacataatcagccctataatgaaacttcatccattcccccgcctttttttttttttaaaacaaatttcatacttctttatcaatttaaaaagataaacttgatagattggtggcttgttcaaaaatttttttttcttttg

SEQ ID NO: 319309 - DNA, 865 bp, Homo sapiens
ggagagcgcgcggcggacgcgcccgggacgcgcggcggcaccgggaggccgggccgagcgaaatgtggtctcgctgtgttgcccagtactggcctcaagcgagcctcctacctcagccttccaaagtgttgggattataggcgtgagccactgcacctggcacagtcttaaaacattttggaaaaagttgaagctctccttttctaccctcctgattctgtgcttctgttggagtgcatatcacttgatggcttctaagacaaatgctaaattcttgtcagattacgcagttttgagagattacctgaagttgcactcaaaagcaagatatactactaactttgaaatggaataaggccctccctatcctgaagacattagctgagagtctggcaccttttaaaggtctgatcatcaattgtctctctgggcggccacctatgagacttcatctgtgtgctttataaatagcagtccagggcaacagtacttgataaaaaggttataccttattggtgtggacgttgtctaaatttcggtagccatggcacaagaatatagatgtggagaaagtttgggacctcaagagaaagagtggatgtctacagctgcacaaggaagggcaaaccagcagagctcctgggacctgctgaaggaggaaagatgcccgagagctgggcagaggaaaatccctcctgctttcaacaactatgcatttccaaatgtcgaaagagagattgcagagctcaacaacatgaatattttctggcttacctgccaatggtttttttctccccctaaaatgaaacaatatccattatctctagcgacatgtctattttaactttgtcactgttaacagtgg

SEQ ID NO: 319310 - DNA, 604 bp, Homo sapiens
ttttttttttttgagacggagtctcgctcttttgctcaggccggactgcagtggcgctatctctgctcactgcaacctccgcctcctgggttcacgccattctcctgcctcagcctcccgaatggctgggactacaggcgcctgccactgcacccggctaattttttgtatttttagtagagatgaggtttcgccatgttggctaggcttgtcttgagctcttgacctcagatgatcggcctgcctcggcttcccaaagtgttagaattacaggcgtgagccaccatgcccggatgtattaatggtattttaataataactcttggttgataaacttaaacatgacagttttgagcaggcaccttaagttctgtatactaccgtgaggccaggcacttgtttagcttctgtgtcatacagctaccccttgtattttgttctttttttttttagtataataaatctatagttttattaacacagaaactgatagtgtggtatgaggtttacgtttaaacaaagttttcacagaaatctaacacatgcctaaaaagattttacaatctagctctagatgcaagtccagacaatatcaagaactgat

SEQ ID NO: 319311 - DNA, 424 bp, Homo sapiens
catgattggcatgagaaccagaggatccctattttgcctgtggaaatcaccacaggtttggagtgagccgtagatccccagcctccattgacaggcagaacacccagtcagatattggtggcagcggaaaatccacgcctagctggcaaagaagtgaggatagcattgctgaccagatggcttacagttatagaggacctcaggatttcaattcttttgtcctcgagcagcatgaatatacaggtaaaatatttccaaagtgtcatggtaagtaacacgtgattgcatccatgcctgtctaggtaatgtagaccaagctaggttagccacacttggcaatgaatgaatttcataaatttaattcatataatctaaatttttcccccaaaccaaaagttgattctgaactttgctgcgttgttca

SEQ ID NO: 319312 - DNA, 6518 bp, Homo sapiens
ggagagcgcgcggcggacgcgcccgggacgcgcggcggcaccgggaggccgggccgagcgaaatgtggtctcgctgtgttgcccagtactggcctcaagcgagcctcctacctcagccttccaaagtgttgggattataggcgtgagccactgcacctggcacagtcttaaaacattttggaaaaagttgaagctctccttttctaccctcctgattctgtgcttctgttggagtgcatatcacttgatggcttctaagacaaatgctaaattcttgtcagattacgcagttttgagagattacctgaagttgcactcaaaagcaagatatactactaactttgaaatggaataaggccctccctatcctgaagacattagctgagagtctggcaccttttaaaggtctgatcatcaattgtctctctgggcggccacctatgagacttcatctgtgtgctttataaatagcagtccagggcaacagtacttgataaaaaggttataccttattggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcctctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaattccttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggcttacagttatagaggacctcaggatttcaattcttttgtcctcgagcagcatgaatatacagagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgcta

SEQ ID NO: 319313 - DNA, 6455 bp, Homo sapiens
ggagagcgcgcggcggacgcgcccgggacgcgcggcggcaccgggaggccgggccgagcgaaatgtggtctcgctgtgttgcccagtactggcctcaagcgagcctcctacctcagccttccaaagtgttgggattataggcgtgagccactgcacctggcacagtcttaaaacattttggaaaaagttgaagctctccttttctaccctcctgattctgtgcttctgttggagtgcatatcacttgatggcttctaagacaaatgctaaattcttgtcagattacgcagttttgagagattacctgaagttgcactcaaaagcaagatatactactaactttgaaatggaataaggccctccctatcctgaagacattagctgagagtctggcaccttttaaaggtctgatcatcaattgtctctctgggcggccacctatgagacttcatctgtgtgctttataaatagcagtccagggcaacagtacttgataaaaaggttataccttattggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcctctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaattccttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgcta

SEQ ID NO: 319314 - DNA, 8264 bp, Homo sapiens
ggagagcgcgcggcggacgcgcccgggacgcgcggcggcaccgggaggccgggccgagcgaaatgtggtctcgctgtgttgcccagtactggcctcaagcgagcctcctacctcagccttccaaagtgttgggattataggcgtgagccactgcacctggcacagtcttaaaacattttggaaaaagttgaagctctccttttctaccctcctgattctgtgcttctgttggagtgcatatcacttgatggcttctaagacaaatgctaaattcttgtcagattacgcagttttgagagattacctgaagttgcactcaaaagcaagatatactactaactttgaaatggaataaggccctccctatcctgaagacattagctgagagtctggcaccttttaaaggtctgatcatcaattgtctctctgggcggccacctatgagacttcatctgtgtgctttataaatagcagtccagggcaacagtacttgataaaaaggttataccttattggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcctctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaattccttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgctaaaatgtgaatgtctttatttttttgcacaatatctatctgttatgtatttaagaagaaactgggccttggaccagggcgccccctggcccatccgcctctattcccatcagctttcttatcaacttcaggtaacccaagctttcccttgttattctaacaaatatcattattcctagaaaaagaatgtttttataacttgtttggggagtagagagggatatttccttaccttcttccctaaaatgcctggagagggagttgctttgagaaaatgcctacctcccttgaatgactcgtgcatgagctagtgctgtctgtacctgtcctccagagatcagcaggaccggagttaaatatttaacagcaagtctgtaaaccagagcagctctgacagtgcctgcaggccacaccccttctcagtcctgcattgtgaggtcatttcctgcttctccctttccccaggaagatggtcccacttgtgctgcaagactcttttttgtttggcttaattgagccccactaaattggaatcaatctctcttacagcttcctggctccaaacattaattgatttcagaattcccccaaactaaaaccttatctgtctgcattttgaatgcattttggtcaaaagtatacgttttaaagatttttaaagataaaaatgtggcacaactggtttttttagcttgctgaaaatgaccatatctctaaattaatctttctctccagagcaagacttcaccagtatttgtaactaggagaagctaacagtgaatgtttaattgtgaattttaatcattgcttgttaggaataatgactgtgatactagaatgggcttttgaaacctgcatgtcccagtgtgaaatttcagcacggcattttctgcatcctttcatgggccatccaaagggattccgctgcagaaattattgatgtgctatttttgctgtcttgtgatgcaggctgctttgggcccctgggtcactcttccaaggctgctgtagagcacagagacatggggctggccagtgttgactgacctgaggagacccctttgtttgttgccttcataactgtcactaaaccgacccctctgccctttcagtggcaactctggtctaagggaacattcagcactctagcggcatctgattggaagttccctcacccaagtaatctcaattccttcctctctccatccctgaaagaaacaggatggattttcctctcttctccctgctacattcactaccagatttttatgctacagtttcattcttgattgtgatttctccatggaattttttttttctggtgacatttctatcatggaaataggaagatttcggagtgctttgtgaagatttcaattgtctgtctctttctctctttgacttgtatgaaggagattgtacattgcctgatatctctttgtaaatgagaaatattgctaacatccaagcattctgaagtcttgcttatccttctgagtttagttctcattttgttttacattttgtttggggacttggggcaagctatttattagagttttgcaacagagttcttgtttgaagcctctaaagactacctgtaaaattcaaagaataaaattcattttaaacgctcttttaaaacactttggtattattgcttgaggtttgcttatttgaaagaccacccaataactcattgaccctccttgcatccgaattttttcatcaagctttgttaacactaatgatgattcttgaaaatttctgtccttctcagaatgttaataaacttttttactctgtccaca

SEQ ID NO: 319315 - DNA, 8215 bp, Homo sapiens
ggagagcgcgcggcggacgcgcccgggacgcgcggcggcaccgggaggccgggccgagcgaaatgtggtctcgctgtgttgcccagtactggcctcaagcgagcctcctacctcagccttccaaagtgttgggattataggcgtgagccactgcacctggcacagtcttaaaacattttggaaaaagttgaagctctccttttctaccctcctgattctgtgcttctgttggagtgcatatcacttgatggcttctaagacaaatgctaaattcttgtcagattacgcagttttgagagattacctgaagttgcactcaaaagcaagatatactactaactttgaaatggaataaggccctccctatcctgaagacattagctgagagtctggcaccttttaaaggtctgatcatcaattgtctctctgggcggccacctatgagacttcatctgtgtgctttataaatagcagtccagggcaacagtacttgataaaaaggttataccttattggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcctctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaattccttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgctaaaatgtgaatgtctttatttttttgcacaatatctatctgttatgtatttaagaagaaactgggccttggaccagggcgccccctggcccatccgcctctattcccatcagctttcttatcaacttcaggtaacccaagctttcccttgttattctaacaaatatcattattcctagaaaaagaatgtttttataacttgtttggggagtagagagggatatttccttaccttcttccctaaaatgcctggagagggagttgctttgagaaaatgcctacctcccttgaatgactcgtgcatgagctagtgctgtctgtacctgtcctccagagatcagcaggaccggagttaaatatttaacagcaagtctgtaaaccagagcagctctgacagtgcctgcaggccacaccccttctcagtcctgcattgtgaggtcatttcctgcttctccctttccccaggaagatggtcccacttgtgctgcaagactcttttttgtttggcttaattgagccccactaaattggaatcaatctctcttacagcttcctggctccaaacattaattgatttcagaattcccccaaactaaaaccttatctgtctgcattttgaatgcattttggtcaaaagtatacgttttaaagatttttaaagataaaaatgtggcacaactggtttttttagcttgctgaaaatgaccatatctctaaattaatctttctctccagagcaagacttcaccagtatttgtaactaggagaagctaacagtgaatgtttaattgtgaattttaatcattgcttgttaggaataatgactgtgatactagaatgggcttttgaaacctgcatgtcccagtgtgaaatttcagcacggcattttctgcatcctttcatgggccatccaaagggattccgctgcagaaattattgatgtgctatttttgctgtcttgtgatgcaggctgctttgggcccctgggtcactcttccaaggctgctgtagagcacagagacatggggctggccagtgttgactgacctgaggagacccctttgtttgttgccttcataactgtcactaaaccgacccctctgccctttcagtggcaactctggtctaagggaacattcagcactctagcggcatctgattggaagttccctcacccaagtaatctcaattccttcctctctccatccctgaaagaaacaggatggattttcctctcttctccctgctacattcactaccagatttttatgctacagtttcattcttgattgtgatttctccatggaattttttttttctggtgacatttctatcatggaaataggaagatttcggagtgctttgtgaagatttcaattgtctgtctctttctctctttgacttgtatgaaggagattgtacattgcctgatatctctttgtaaatgagaaatattgctaacatccaagcattctgaagtcttgcttatccttctgagtttagttctcattttgttttacattttgtttggggacttggggcaagctatttattagagttttgcaacagagttcttgtttgaagcctctaaagactacctgtaaaattcaaagaataaaattcattttaaacgctcttttaaaacactttggtattattgcttgaggtttgcttatttgaaagaccacccaataactcattgaccctccttgcatccgaattttttcatcaagctttgttaacactaatgatgattcttgaaaatttctgtccttctcagaatgttaataaacttttttactctgtccaca

SEQ ID NO: 319316 - DNA, 3216 bp, Homo sapiens
agcgagctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgctaaaatgtgaatgtctttatttttttgcacaatatctatctgttatgtatttaagaagaaactgggccttggaccagggcgccccctggcccatccgcctctattcccatcagctttcttatcaacttcaggtaacccaagctttcccttgttattctaacaaatatcattattcctagaaaaagaatgtttttataacttgtttggggagtagagagggatatttccttaccttcttccctaaaatgcctggagagggagttgctttgagaaaatgcctacctcccttgaatgactcgtgcatgagctagtgctgtctgtacctgtcctccagagatcagcaggaccggagttaaatatttaacagcaagtctgtaaaccagagcagctctgacagtgcctgcaggccacaccccttctcagtcctgcattgtgaggtcatttcctgcttctccctttccccaggaagatggtcccacttgtgctgcaagactcttttttgtttggcttaattgagccccactaaattggaatcaatctctcttacagcttcctggctccaaacattaattgatttcagaattcccccaaactaaaaccttatctgtctgcattttgaatgcattttggtcaaaagtatacgttttaaagatttttaaagataaaaatgtggcacaactggtttttttagcttgctgaaaatgaccatatctctaaattaatctttctctccagagcaagacttcaccagtatttgtaactaggagaagctaacagtgaatgtttaattgtgaattttaatcattgcttgttaggaataatgactgtgatactagaatgggcttttgaaacctgcatgtcccagtgtgaaatttcagcacggcattttctgcatcctttcatgggccatccaaagggattccgctgcagaaattattgatgtgctatttttgctgtcttgtgatgcaggctgctttgggcccctgggtcactcttccaaggctgctgtagagcacagagacatggggctggccagtgttgactgacctgaggagacccctttgtttgttgccttcataactgtcactaaaccgacccctctgccctttcagtggcaactctggtctaagggaacattcagcactctagcggcatctgattggaagttccctcacccaagtaatctcaattccttcctctctccatccctgaaagaaacaggatggattttcctctcttctccctgctacattcactaccagatttttatgctacagtttcattcttgattgtgatttctccatggaattttttttttctggtgacatttctatcatggaaataggaagatttcggagtgctttgtgaagatttcaattgtctgtctctttctctctttgacttgtatgaaggagattgtacattgcctgatatctctttgtaaatgagaaatattgctaacatccaagcattctgaagtcttgcttatccttctgagtttagttctcattttgttttacattttgtttggggacttggggcaagctatttattagagttttgcaacagagttcttgtttgaagcctctaaagactacctgtaaaattcaaagaataaaattcattttaaacgctcttttaaaacactttggtattattgcttgaggtttgcttatttgaaagaccacccaataactcattgaccctccttgcatccgaattttttcatcaagctttgttaacactaatgatgattcttgaaaatttctgtccttctcagaatgttaataaacttttttactctgtccaca

SEQ ID NO: 319317 - DNA, 6187 bp, Homo sapiens
ggagagcgcgcggcggacgcgcccgggacgcgcggcggcaccgggaggccgggccgagcgaaatgtggtctcgctgtgttgcccagtactggcctcaagcgagcctcctacctcagccttccaaagtgttgggattataggcgtgagccactgcacctggcacagtcttaaaacattttggaaaaagttgaagctctccttttctaccctcctgattctgtgcttctgttggagtgcatatcacttgatggcttctaagacaaatgctaaattcttgtcagattacgcagttttgagagattacctgaagttgcactcaaaagcaagatatactactaactttgaaatggaataaggccctccctatcctgaagacattagctgagagtctggcaccttttaaaggtctgatcatcaattgtctctctgggcggccacctatgagacttcatctgtgtgctttataaatagcagtccagggcaacagtacttgataaaaaggttataccttattggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcctctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaattccttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcaggttggtcccagtgcaagggcagtactctgcaccttgtgtcacatctgccactgactgcatctgtggggagaagagatggaagccacacggagtagctgagtgaagctgatcactgcagggctagacactttacattttagtcagaacgctttgtaactgaatactgtagacataattaaactattcttgatgacttatatgg

SEQ ID NO: 319318 - DNA, 5673 bp, Homo sapiens
ggagagcgcgcggcggacgcgcccgggacgcgcggcggcaccgggaggccgggccgagcgaaatgtggtctcgctgtgttgcccagtactggcctcaagcgagcctcctacctcagccttccaaagtgttgggattataggcgtgagccactgcacctggcacagtcttaaaacattttggaaaaagttgaagctctccttttctaccctcctgattctgtgcttctgttggagtgcatatcacttgatggcttctaagacaaatgctaaattcttgtcagattacgcagttttgagagattacctgaagttgcactcaaaagcaagatatactactaactttgaaatggaataaggccctccctatcctgaagacattagctgagagtctggcaccttttaaaggtctgatcatcaattgtctctctgggcggccacctatgagacttcatctgtgtgctttataaatagcagtccagggcaacagtacttgataaaaaggttataccttattggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcctctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaattccttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcccagttccctaattttcctcctgggctcctttagaactcgaagtgggaagcttccaacccctgtaatgacatctaacttgtcttcaaaaggcagtttgcacattaaaagtctccctgataacttcaaaagggactgaagtatcgataattcatccctttctccccgggatgcaggggt

SEQ ID NO: 319319 - DNA, 3501 bp, Homo sapiens
ggagagcgcgcggcggacgcgcccgggacgcgcggcggcaccgggaggccgggccgagcgaaatgtggtctcgctgtgttgcccagtactggcctcaagcgagcctcctacctcagccttccaaagtgttgggattataggcgtgagccactgcacctggcacagtcttaaaacattttggaaaaagttgaagctctccttttctaccctcctgattctgtgcttctgttggagtgcatatcacttgatggcttctaagacaaatgctaaattcttgtcagattacgcagttttgagagattacctgaagttgcactcaaaagcaagatatactactaactttgaaatggaataaggccctccctatcctgaagacattagctgagagtctggcaccttttaaaggtctgatcatcaattgtctctctgggcggccacctatgagacttcatctgtgtgctttataaatagcagtccagggcaacagtacttgataaaaaggttataccttattggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcctctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaattccttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgaccttaattatctgatcccagttgatagagaagattagaagcaaaaaaaagaagaaggagctgttaatagcgagtatatactggaaacaaatacttgtttattgatagaagagatgctgaaaaactattcacatcaaagatatgaattcaataagcatagcaatctggggccatttgattttggggcaaacagccaaatatagtagttcctccttatctgttggggatatattccaagacccccagaggatgcccgaaaccatggatagtgcctacccctatatatactatgtttgttcctatatgataacgtttaatttctaaattaggcacagtaatatattaacagtaattaataaaatataacagttataacaatata

SEQ ID NO: 319320 - DNA, 135 bp, Homo sapiens
ccttaggaatgaaatcgctgcatggtaagtggtctttcagctgcagcctggatggccctgttgatgatggtcagtgtccccagacgtggctgccactcatgtgctcagagaggggtcctgtatccatgctcagat

SEQ ID NO: 319321 - DNA, 468 bp, Homo sapiens
tgctagctctcgaacgcatttatttcattgctgagtggaaagccttggtctggaaatttggcacaaggactgtttccagagaaacatttcatagaatgctacagtgatgagcagggaagaggggggactagaaattgactcacaaatgtttcttaaagggaaattacatggctacaatcctcttatagctaaaacagtcatatttttccctgtgagggttgggaaataagatttccagtgcatcctgcactggaaatactagacatgactgccaactagaccacttgttgactttgatagatagggccagggatgtggttccaaaatactaagtggtttcttctctcctttccagtccagagagcctcattttttgctgctagtgatgaaaaccatcgccccttgagtgctgcatccaacagtgatcagctggaggaccaggctctggcccagatgaagccttacagc

SEQ ID NO: 319322 - DNA, 341 bp, Homo sapiens
caagtcccgtcccaggtgcagagtcccatgacctcgcggctgaatgctggaaaaggagatgggaagatgcctcctccagaaagagccgccaacatccctcgaagcatctccagtgacgggcgcccactagagaggcggtaagtgtgccttcaaaggtttgctctatctctctctgccccaaatgtaagtaacacagacccataagcactagttttaggccttctcatattttactagaaacaaagaattaaactgaggtgcataccgtagtgactttcaaagcatggtagtgttccaaagccataaggatcaacagagattgattctagcaaagccttcag

SEQ ID NO: 319323 - DNA, 562 bp, Homo sapiens
ctgctccctgagcttagagtgtcttagcacctgataccagtccgtttagacaggtgtttggaggaacgaagaatagaaatggacaaaagatcaaaacgggtccatagctattactcagaagagctgggcaaggtggggccaacacctcttagcttttctacttcactctgcctcccaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgct

SEQ ID NO: 319324 - DNA, 482 bp, Homo sapiens
ctcttcagctggcaataaggtattcagaactaaccctgcttgcaatgattttccagttccatgtccaccacttaataccctattgctttaaaccacagtatcttttatttccttgtctagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggtaggtctgaggagacagctgtgggcctgagactcgagtgcagggtttgtgtaccatgtagaacatctcttagcaggtagtggagta

SEQ ID NO: 319325 - DNA, 240 bp, Homo sapiens
tcactgggatgaatggattagatggatttgatggattggatggatggatgggatggatggatggatggacaggatggatgggtggatgaatgctggaaaaggagatgggaagatgcctcctccagaaagagccgccaacatccctcgaagcatctccagtgacgggcgcccactagagaggcggacgtctcctggttcggacatctaagtgacgttcctcatcccagtgacgttcctcat

SEQ ID NO: 319326 - DNA, 8157 bp, Homo sapiens
ggagagcgcgcggcggacgcgcccgggacgcgcggcggcaccgggaggccgggccgagcgaaatgtggtctcgctgtgttgcccagtactggcctcaagcgagcctcctacctcagccttccaaagtgttgggattataggcgtgagccactgcacctggcacagtcttaaaacattttggaaaaagttgaagctctccttttctaccctcctgattctgtgcttctgttggagtgcatatcacttgatggcttctaagacaaatgctaaattcttgtcagattacgcagttttgagagattacctgaagttgcactcaaaagcaagatatactactaactttgaaatggaataaggccctccctatcctgaagacattagctgagagtctggcaccttttaaaggtctgatcatcaattgtctctctgggcggccacctatgagacttcatctgtgtgctttataaatagcagtccagggcaacagtacttgataaaaaggttataccttattggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcctctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaattccttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggcttacagttatagaggacctcaggatttcaattcttttgtcctcgagcagcatgaatatacagagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgctaaaatgtgaatgtctttatttttttgcacaatatctatctgttatgtatttaagaagaaactgggccttggaccagggcgccccctggcccatccgcctctattcccatcagctttcttatcaacttcaggtaacccaagctttcccttgttattctaacaaatatcattattcctagaaaaagaatgtttttataacttgtttggggagtagagagggatatttccttaccttcttccctaaaatgcctggagagggagttgctttgagaaaatgcctacctcccttgaatgactcgtgcatgagctagtgctgtctgtacctgtcctccagagatcagcaggaccggagttaaatatttaacagcaagtctgtaaaccagagcagctctgacagtgcctgcaggccacaccccttctcagtcctgcattgtgaggtcatttcctgcttctccctttccccaggaagatggtcccacttgtgctgcaagactcttttttgtttggcttaattgagccccactaaattggaatcaatctctcttacagcttcctggctccaaacattaattgatttcagaattcccccaaactaaaaccttatctgtctgcattttgaatgcattttggtcaaaagtatacgttttaaagatttttaaagataaaaatgtggcacaactggtttttttagcttgctgaaaatgaccatatctctaaattaatctttctctccagagcaagacttcaccagtatttgtaactaggagaagctaacagtgaatgtttaattgtgaattttaatcattgcttgttaggaataatgactgtgatactagaatgggcttttgaaacctgcatgtcccagtgtgaaatttcagcacggcattttctgcatcctttcatgggccatccaaagggattccgctgcagaaattattgatgtgctatttttgctgtcttgtgatgcaggctgctttgggcccctgggtcactcttccaaggctgctgtagagcacagagacatggggctggccagtgttgactgacctgaggagacccctttgtttgttgccttcataactgtcactaaaccgacccctctgccctttcagtggcaactctggtctaagggaacattcagcactctagcggcatctgattggaagttccctcacccaagtaatctcaattccttcctctctccatccctgaaagaaacaggatggattttcctctcttctccctgctacattcactaccagatttttatgctacagtttcattcttgattgtgatttctccatggaattttttttttctggtgacatttctatcatggaaataggaagatttcggagtgctttgtgaagatttcaattgtctgtctctttctctctttgacttgtatgaaggagattgtacattgcctgatatctctttgtaaatgagaaatattgctaacatccaagcattctgaagtcttgcttatccttctgagtttagttctcattttgttttacattttgtttggggacttggggcaagctatttattagagttttgcaacagagttcttgtttgaagcctctaaagactacctgtaaaattcaaagaataaaattcattttaaacgctctttta

SEQ ID NO: 319327 - DNA, 8210 bp, Homo sapiens
ggagagcgcgcggcggacgcgcccgggacgcgcggcggcaccgggaggccgggccgagcgaaatgtggtctcgctgtgttgcccagtactggcctcaagcgagcctcctacctcagccttccaaagtgttgggattataggcgtgagccactgcacctggcacagtcttaaaacattttggaaaaagttgaagctctccttttctaccctcctgattctgtgcttctgttggagtgcatatcacttgatggcttctaagacaaatgctaaattcttgtcagattacgcagttttgagagattacctgaagttgcactcaaaagcaagatatactactaactttgaaatggaataaggccctccctatcctgaagacattagctgagagtctggcaccttttaaaggtctgatcatcaattgtctctctgggcggccacctatgagacttcatctgtgtgctttataaatagcagtccagggcaacagtacttgataaaaaggttataccttattggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcctctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaattccttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgctaaaatgtgaatgtctttatttttttgcacaatatctatctgttatgtatttaagaagaaactgggccttggaccagggcgccccctggcccatccgcctctattcccatcagctttcttatcaacttcaggtaacccaagctttcccttgttattctaacaaatatcattattcctagaaaaagaatgtttttataacttgtttggggagtagagagggatatttccttaccttcttccctaaaatgcctggagagggagttgctttgagaaaatgcctacctcccttgaatgactcgtgcatgagctagtgctgtctgtacctgtcctccagagatcagcaggaccggagttaaatatttaacagcaagtctgtaaaccagagcagctctgacagtgcctgcaggccacaccccttctcagtcctgcattgtgaggtcatttcctgcttctccctttccccaggaagatggtcccacttgtgctgcaagactcttttttgtttggcttaattgagccccactaaattggaatcaatctctcttacagcttcctggctccaaacattaattgatttcagaattcccccaaactaaaaccttatctgtctgcattttgaatgcattttggtcaaaagtatacgttttaaagatttttaaagataaaaatgtggcacaactggtttttttagcttgctgaaaatgaccatatctctaaattaatctttctctccagagcaagacttcaccagtatttgtaactaggagaagctaacagtgaatgtttaattgtgaattttaatcattgcttgttaggaataatgactgtgatactagaatgggcttttgaaacctgcatgtcccagtgtgaaatttcagcacggcattttctgcatcctttcatgggccatccaaagggattccgctgcagaaattattgatgtgctatttttgctgtcttgtgatgcaggctgctttgggcccctgggtcactcttccaaggctgctgtagagcacagagacatggggctggccagtgttgactgacctgaggagacccctttgtttgttgccttcataactgtcactaaaccgacccctctgccctttcagtggcaactctggtctaagggaacattcagcactctagcggcatctgattggaagttccctcacccaagtaatctcaattccttcctctctccatccctgaaagaaacaggatggattttcctctcttctccctgctacattcactaccagatttttatgctacagtttcattcttgattgtgatttctccatggaattttttttttctggtgacatttctatcatggaaataggaagatttcggagtgctttgtgaagatttcaattgtctgtctctttctctctttgacttgtatgaaggagattgtacattgcctgatatctctttgtaaatgagaaatattgctaacatccaagcattctgaagtcttgcttatccttctgagtttagttctcattttgttttacattttgtttggggacttggggcaagctatttattagagttttgcaacagagttcttgtttgaagcctctaaagactacctgtaaaattcaaagaataaaattcattttaaacgctcttttaaaacactttggtattattgcttgaggtttgcttatttgaaagaccacccaataactcattgaccctccttgcatccgaattttttcatcaagctttgttaacactaatgatgattcttgaaaatttctgtccttctcagaatgttaataaacttttttactctgtccaca

SEQ ID NO: 319328 - DNA, 4006 bp, Homo sapiens
tggtttggtggtacttggctatgctaatgtgtatgacgtgacaagttgtcaccagctgcaagctttatccatcagccacttaagtttctgacctgctgtctatcaaatagactcttaacaagcttactgctgaaatgcagagtttgctggtcagtgaactgaaagatgcaatggcaagccatcttcatttgtcaccatgtgcttgtttctgcttagtgcctgcaccataatgtcctatgctgtattccagagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgctaaaatgtgaatgtctttatttttttgcacaatatctatctgttatgtatttaagaagaaactgggccttggaccagggcgccccctggcccatccgcctctattcccatcagctttcttatcaacttcaggtaacccaagctttcccttgttattctaacaaatatcattattcctagaaaaagaatgtttttataacttgtttggggagtagagagggatatttccttaccttcttccctaaaatgcctggagagggagttgctttgagaaaatgcctacctcccttgaatgactcgtgcatgagctagtgctgtctgtacctgtcctccagagatcagcaggaccggagttaaatatttaacagcaagtctgtaaaccagagcagctctgacagtgcctgcaggccacaccccttctcagtcctgcattgtgaggtcatttcctgcttctccctttccccaggaagatggtcccacttgtgctgcaagactcttttttgtttggcttaattgagccccactaaattggaatcaatctctcttacagcttcctggctccaaacattaattgatttcagaattcccccaaactaaaaccttatctgtctgcattttgaatgcattttggtcaaaagtatacgttttaaagatttttaaagataaaaatgtggcacaactggtttttttagcttgctgaaaatgaccatatctctaaattaatctttctctccagagcaagacttcaccagtatttgtaactaggagaagctaacagtgaatgtttaattgtgaattttaatcattgcttgttaggaataatgactgtgatactagaatgggcttttgaaacctgcatgtcccagtgtgaaatttcagcacggcattttctgcatcctttcatgggccatccaaagggattccgctgcagaaattattgatgtgctatttttgctgtcttgtgatgcaggctgctttgggcccctgggtcactcttccaaggctgctgtagagcacagagacatggggctggccagtgttgactgacctgaggagacccctttgtttgttgccttcataactgtcactaaaccgacccctctgccctttcagtggcaactctggtctaagggaacattcagcactctagcggcatctgattggaagttccctcacccaagtaatctcaattccttcctctctccatccctgaaagaaacaggatggattttcctctcttctccctgctacattcactaccagatttttatgctacagtttcattcttgattgtgatttctccatggaattttttttttctggtgacatttctatcatggaaataggaagatttcggagtgctttgtgaagatttcaattgtctgtctctttctctctttgacttgtatgaaggagattgtacattgcctgatatctctttgtaaatgagaaatattgctaacatccaagcattctgaagtcttgcttatccttctgagtttagttctcattttgttttacattttgtttggggacttggggcaagctatttattagagttttgcaacagagttcttgtttgaagcctctaaagactacctgtaaaattcaaagaataaaattcattttaaacgctcttttaaaacactttggtattattgcttgaggtttgcttatttgaaagaccacccaataactcattgaccctccttgcatccgaattttttcatcaagctttgttaacactaatgatgattcttgaaaatttctgtccttctcagaatgttaataaacttttttactctgtccaca

SEQ ID NO: 319329 - DNA, 2216 bp, Homo sapiens
ggagagcgcgcggcggacgcgcccgggacgcgcggcggcaccgggaggccgggccgagcgaaatgtggtctcgctgtgttgcccagtactggcctcaagcgagcctcctacctcagccttccaaagtgttgggattataggcgtgagccactgcacctggcacagtcttaaaacattttggaaaaagttgaagctctccttttctaccctcctgattctgtgcttctgttggagtgcatatcacttgatggcttctaagacaaatgctaaattcttgtcagattacgcagttttgagagattacctgaagttgcactcaaaagcaagatatactactaactttgaaatggaataaggccctccctatcctgaagacattagctgagagtctggcaccttttaaaggtctgatcatcaattgtctctctgggcggccacctatgagacttcatctgtgtgctttataaatagcagtccagggcaacagtacttgataaaaaggttataccttattggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcctctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgcta

SEQ ID NO: 319330 - DNA, 775 bp, Homo sapiens
ggagagcgcgcggcggacgcgcccgggacgcgcggcggcaccgggaggccgggccgagcgaaatgtggtctcgctgtgttgcccagtactggcctcaagcgagcctcctacctcagccttccaaagtgttgggattataggcgtgagccactgcacctggcacagtcttaaaacattttggaaaaagttgaagctctccttttctaccctcctgattctgtgcttctgttggagtgcatatcacttgatggcttctaagacaaatgctaaattcttgtcagattacgcagttttgagagattacctgaagttgcactcaaaagcaagatatactactaactttgaaatggaataaggtgagttggtggattagttccaaagtcacattgcagggaggaaatgtcactcaaactgtcattcttagaagacctgctatttggccaggcgtgagccaccatgcccggatgtattaatggtattttaataataactcttggttgataaacttaaacatgacagttttgagcaggcaccttaagttctgtatactaccgtgaggccaggcacttgtttagcttctgtgtcatacagctaccccttgtattttgttctttttttttttagtataataaatctatagttttattaacacagaaactgatagtgtggtatgaggtttacgtttaaacaaagttttcacagaaatctaacacatgcctaaaaagattttacaatctagctctagatgcaagtccagacaatatcaagaactgat

SEQ ID NO: 319331 - DNA, 296 bp, Homo sapiens
  misc_feature (80)..(80): n is a, c, g, or t
  misc_feature (92)..(92): n is a, c, g, or t
  misc_feature (102)..(102): n is a, c, g, or t
actccctttctcccttccccttttccgcggtttgcgtgatcacctcttttttccattggcccctgtgttgggtaataccncaagggggggtngtgcttcctnggttttttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggac

SEQ ID NO: 319332 - DNA, 2812 bp, Homo sapiens
tatataattctttttatattaaatgcccagaattggcaatccatagagataaaaagtagattcatagttgccaggggctgggaggaagagctgggagaaaatgggtagtgcctgctaatgggtttgtgatttcttttggactaatgaaaatgttctggaattagatagtagtaatcattgcacaactatgtgaatatattaaaaaccactgtattgtacacttaaatttaaactaaagaaaagctgacacatggaggaatgagcagagtcaataaacaggtggttatggtaaaaattatttcacttatgttctagcagaaatgtctgataatctaatattgtagtttaggccttgaatgttgtaatttgtactttattgccctgttcctgactttcacagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggac

SEQ ID NO: 319333 - DNA, 3466 bp, Homo sapiens
  misc_feature (3466)..(3466): n is a, c, g, or t
aggtggggaggaagagctgccggaagtaggcggtggaggtggtagcggagctgacggcagctgccagggaaaccgaggcgcgggacgcaaggccagcagacaggccggccagagggtcatctgcgtccggcacccaggaggctcgtggtccgcctttgcctgggctgagggtctctggccccgcagcctctcttggaggcgggcctgtccctaagcccgccaaggggcgccgcgccgaggggctgcggagtgggggacggacgcccccgacccgggaaggggcgtccggcggggccggaggagagggctctccccgctcaggaggtgcccctgggcgggggaccgggagtcctcaaccccggactgaggcaggggtctctgggggcgaggagggcgcgtcgccctctgcccccgccggcaccctggccatgacaggcaagtcggtgaaggacgtggatcggtaccaggctgtcctggccaacctgctgctggaggaggataacaagttttgtgcagattgccagtctaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaagaaaaaaaaaaaagaagaataaaaaaaaaaaaaaaaaaaaaacaaaggtggggcggctatgaggtaccatatacttcatcgcacgggaggcacgaagagccataatcagagcccgctacgaaagtgtgtaagcagagtagcggcttgtaaggaaaggggttggacaataataacgatcgagggggcggacggaatgattgacataaagacgaatgagggtgggagagacaaaagattagccggtgcaggactctatgcgagaaacaactaattcgtgagtgggggagaaacctggacggaacactcctcctcaataattagtccccgaggcggtgtttaaaaaacggggtgtattggtgtgggtgacccagcgttctgtcctggggaacgtcgcggggtggaaaataaattacaggn

SEQ ID NO: 319334 - DNA, 2263 bp, Homo sapiens
gctgactctagaggaccccgaaggcgtgggctgggtctatctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggac

SEQ ID NO: 319335 - DNA, 2890 bp, Homo sapiens
aggtggggaggaagagctgccggaagtaggcggtggaggtggtagcggagctgacggcagctgccagggaaaccgaggcgcgggacgcaaggccagcagacaggccggccagagggtcatctgcgtccggcacccaggaggctcgtggtccgcctttgcctgggctgagggtctctggccccgcagcctctcttggaggcgggcctgtccctaagcccgccaaggggcgccgcgccgaggggctgcggagtgggggacggacgcccccgacccgggaaggggcgtccggcggggccggaggagagggctctccccgctcaggaggtgcccctgggcgggggaccgggagtcctcaaccccggactgaggcaggggtctctgggggcgaggagggcgcgtcgccctctgcccccgccggcaccctggccatgacaggcaagtcggtgaaggacgtggatcggtaccaggctgtcctggccaacctgctgctggaggaggataacaagttttgtgcagattgccagtctaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcattgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggac

SEQ ID NO: 319336 - DNA, 2433 bp, Homo sapiens
aggtggggaggaagagctgccggaagtaggcggtggaggtggtagcggagctgacggcagctgccagggaaaccgaggcgcgggacgcaaggccagcagacaggccggccagagggtcatctgcgtccggcacccaggaggctcgtggtccgcctttgcctgggctgagggtctctggccccgcagcctctcttggaggcgggcctgtccctaagcccgccaaggggcgccgcgccgaggggctgcggagtgggggacggacgcccccgacccgggaaggggcgtccggcggggccggaggagagggctctccccgctcaggaggtgcccctgggcgggggaccgggagtcctcaaccccggactgaggcaggggtctctgggggcgaggagggcgcgtcgccctctgcccccgccggcaccctggccatgacaggcaagtcggtgaaggacgtggatcggtaccaggctgtcctggccaacctgctgctggaggaggataacaagttttgtgcagattgccagtctaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacaacttctaagataagccacaacttctaaggttaag

SEQ ID NO: 319337 - DNA, 817 bp, Homo sapiens
ggatgtgtgtctgtgtgtgggatcttcataaagtctttggtgctaataaaggctgactgaagcagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggac

SEQ ID NO: 319338 - DNA, 1232 bp, Homo sapiens
aggtggggaggaagagctgccggaagtaggcggtggaggtggtagcggagctgacggcagctgccagggaaaccgaggcgcgggacgcaaggccagcagacaggccggccagagggtcatctgcgtccggcacccaggaggctcgtggtccgcctttgcctgggctgagggtctctggccccgcagcctctcttggaggcgggcctgtccctaagcccgccaaggggcgccgcgccgaggggctgcggagtgggggacggacgcccccgacccgggaaggggcgtccggcggggccggaggagagggctctccccgctcaggaggtgcccctgggcgggggaccgggagtcctcaaccccggactgaggcaggggtctctgggggcgaggagggcgcgtcgccctctgcccccgccggcaccctggccatgacaggcaagtcggtgaaggacgtggatcggtaccaggctgtcctggccaacctgctgctggaggaggataacaagttttgtgcagattgccagtctaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccgtatcttttctggagcaacttagaaggctgagtggtattttgatgcttggggagagtcagacaagactccagtcctgtaatgtgactgggtcatctctatgtggattagtcagtgtccttgcttgtcctctgtcctgcaatcaaggtgcacaaaaagcacatgtatttgtgaatgtcggaattgtcatacggtgtcacttgaagaagactcactctggaattaagactgcagtgatttcactgtgaattcttctataaagttacatctccactagtttattttggatctctgaaactattgtttgattaaaaagagtagttcattgtgctctgttaaccctggcagtcagcaaaattgccattcattattatcatctttttatgtcttgggtgaaagaattaactgttgttaccagtttgtcaataaccaataactttcttccaccatctgttcaacagagcatagcacctaggacacaaa

SEQ ID NO: 319339 - DNA, 2943 bp, Homo sapiens
aggtggggaggaagagctgccggaagtaggcggtggaggtggtagcggagctgacggcagctgccagggaaaccgaggcgcgggacgcaaggccagcagacaggccggccagagggtcatctgcgtccggcacccaggaggctcgtggtccgcctttgcctgggctgagggtctctggccccgcagcctctcttggaggcgggcctgtccctaagcccgccaaggggcgccgcgccgaggggctgcggagtgggggacggacgcccccgacccgggaaggggcgtccggcggggccggaggagagggctctccccgctcaggaggtgcccctgggcgggggaccgggagtcctcaaccccggactgaggcaggggtctctgggggcgaggagggcgcgtcgccctctgcccccgccggcaccctggccatgacaggcaagtcggtgaaggacgtggatcggtaccaggctgtcctggccaacctgctgctggaggaggataacaagttttgtgcagattgccagtctaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggac

SEQ ID NO: 319340 - DNA, 2444 bp, Homo sapiens
ggaaaggaaaactgcttaaatgatttttaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggac

SEQ ID NO: 319341 - DNA, 2558 bp, Homo sapiens
gagaggactttacttactattgcttaaggaagagtcttttatcatcgttctgaatcacattgtctgtggacacaatcactagtgatactggcagagtgaattaggtaatctttaaaccaacctcccttttggtgttaaagtaaaaggttttctaaccactgggagatttgttggctcttggctcttgtaccatcagatacctacctttattcttggcttttcctgggaccaaaaactgctgcttctgttggatcccctgttctgtggttgtcttggtttcagaaagatctgtctctttaggacaccagacaatcacaggcgatatctttgtttttcattttaggtttggtttatgcacttctgcctcctgacttgattctttcacctaatacttcctgagttttgtttctttggtaactctctttgaataacagcagccctacccacaagaacaccgtggctttacagtggagatgggaaaagagttcaaaaccacctgcttatttctttctataacatattttcaccttagccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggac

SEQ ID NO: 319342 - DNA, 2458 bp, Homo sapiens
gtttctgagatggcctgtggtcatttttctccaaacctttgaaatcctgaactagtgattctgccctttcagaaagaaagcctgttgtctgcctttcacagcactgatggttgcactttgtttccatccgcttctgctgattgaggttattggctacttaggcttctaatttctgtacctttccttgctctctgaaaatgaaccctcctccataccttgcccttcaaatagccagaagggagccagccagccccccactgtggtgctgaaatacccttcaggcctgggcgtctgctgccctgtgcctgatagctgggctacaggcttccccagagcactctgggaatgtggggtgaagcctcttttgagaagccccgtccatgctagatggttccagaagtctagatttctaggtccatgagcttatgggccacctttgctttttgtctagaatagaaggaaggcatgggcttaataagcagtgctgcatcttaacttcgatctctctttctagatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggac

SEQ ID NO: 319343 - DNA, 3166 bp, Homo sapiens
  misc_feature (2950)..(2950): n is a, c, g, or t
  misc_feature (2996)..(2996): n is a, c, g, or t
  misc_feature (3028)..(3029): n is a, c, g, or t
  misc_feature (3064)..(3064): n is a, c, g, or t
aggtggggaggaagagctgccggaagtaggcggtggaggtggtagcggagctgacggcagctgccagggaaaccgaggcgcgggacgcaaggccagcagacaggccggccagagggtcatctgcgtccggcacccaggaggctcgtggtccgcctttgcctgggctgagggtctctggccccgcagcctctcttggaggcgggcctgtccctaagcccgccaaggggcgccgcgccgaggggctgcggagtgggggacggacgcccccgacccgggaaggggcgtccggcggggccggaggagagggctctccccgctcaggaggtgcccctgggcgggggaccgggagtcctcaaccccggactgaggcaggggtctctgggggcgaggagggcgcgtcgccctctgcccccgccggcaccctggccatgacaggcaagtcggtgaaggacgtggatcggtaccaggctgtcctggccaacctgctgctggaggaggataacaagttttgtgcagattgccagtctaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggaccaaccanccataaaaaaacaaaagccccccccccccccactctacttttcttnccccacccctcaattcccgacctttccctgcnngcctcccacctgtccctctccccctccccccttcntccttccccctctcttcttcctttctgttcccttttttcttttcccctcctcttcctttttctctctttttcctttcctttttcccccccccccaccccccc

SEQ ID NO: 319344 - DNA, 1310 bp, Homo sapiens
aggtggggaggaagagctgccggaagtaggcggtggaggtggtagcggagctgacggcagctgccagggaaaccgaggcgcgggacgcaaggccagcagacaggccggccagagggtcatctgcgtccggcacccaggaggctcgtggtccgcctttgcctgggctgagggtctctggccccgcagcctctcttggaggcgggcctgtccctaagcccgccaaggggcgccgcgccgaggggctgcggagtgggggacggacgcccccgacccgggaaggggcgtccggcggggccggaggagagggctctccccgctcaggaggtgcccctgggcgggggaccgggagtcctcaaccccggactgaggcaggggtctctgggggcgaggagggcgcgtcgccctctgcccccgccggcaccctggccatgacaggcaagtcggtgaaggacgtggatcggtaccaggctgtcctggccaacctgctgctggaggaggataacaagttttgtgcagattgccagtctaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttggtaagagttggacttttcagcttccatgttcttacaaattttgataaattctcagtgaccctggaagataggtagagatggggttctccagttttgtcttcattgccaagactgttctctcacattcttcctgatctgttttacatctgagcagttgctctaaggaagtgtttactgtgacacttttcagagcgacagtgtggtgtagtggttaagagcatggcctttggagccagtgtcgctctgtgttacttactgtctgtgtgaccatgggtagtttacttaacctctgaatgttgctttcataatcc

SEQ ID NO: 319345 - DNA, 239 bp, Homo sapiens
agtttccctttgtctcattctccccatcctggcagagaaagggactctcaccctgccttttgcactaattggcggaatgcccacagcctggtctgaaagtctcctctctccctttcagatgacccagcagatggctgggatgaacttctatggagccaatggcatgatgaactatggacagtcaatgagtggcggaaatggacaggcagcaaatcagactctcagtcctcagatgtgga

SEQ ID NO: 319346 - DNA, 636 bp, Homo sapiens
gagttgcattattttagtcacttttacttttgtatatgttggaaatcttccaaaacaaaatgtatagccataaaaaaaagggagcaaagtaagaaaaaaaggagagcctaaaaaaaaaggtacaggcaaaaaggtgtgaaaagaaactcatcaagagcaagagtattaaatgagaaacatatgccactgacagagttctcagaagagataaaggctgaattaaaaagagatggaggggaaagttttataagtcaaaaacttaggttaaggtttgtgaatattaaagagcgcttcagattgccaatgaaaggtcatagtagtttctataaagtcaaaagatcaaaaacttgacttaaaagagtaagatctctaaaaccaaaggtaacagcagattcttatgaaatgcaccagaaagctggaaagaaagaagaaataaaatgtgaacttatggaacaagagtgctaagggcctgttctacccaggtatgttatgaaatcaaattcatttagtttgggtgtttgttcctttatgttgggaagataaaaaagaacatataattcgtttcttgagtgaaccagtatttatgagaaataagctgggtgtgtaagaatttaagggatgaaaatattccaagtt

SEQ ID NO: 319347 - DNA, 4321 bp, Homo sapiens
gcgtggtgggaaggggcgggattctgccagccgcggctgccgctggagccggtgtccgggctggtgatggggttaattccctttcgtaagactcttacttgcacccacccagccccgccgtcgccccgccgcgccgcgctccaaccgcctcctcctcctcagtaacgcgggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacagcaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacagatgccagcctgttattgcgctccaggccactatcactccagccaacctcagtatcgcccagtcccttctgttcattacaattcacatctaaaccaaccactgccacaacctgcgcagcagacaggttatcaagttatacccaaccagcagcaaaactaccaaggaatagttggagttcagcaaccccagagtcagagcctagtcagtggccaacccaacagcattggaaatcagattcaaggagtggtcatcccctatacttcagtgccaacatatcaggtttcactgcctcaaggttctcaaggaattccccatcagacttatcaacagcctgttatgttccctaatcagtctaatcaaggatctatgcccacaacaggaatgcctgtttactatagtgtcattccacctggtcaacaaaacaatttaagctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaatataaaaaaaaaa

SEQ ID NO: 319348 - DNA, 5809 bp, Homo sapiens
  misc_feature (1311)..(1311): n is a, c, g, or t
  misc_feature (1358)..(1358): n is a, c, g, or t
  misc_feature (1392)..(1392): n is a, c, g, or t
  misc_feature (1526)..(1526): n is a, c, g, or t
gcgtggtgggaaggggcgggattctgccagccgcggctgccgctggagccggtgtccgggctggtgatggggttaattccctttcgtaagactcttacttgcacccacccagccccgccgtcgccccgccgcgccgcgctccaaccgcctcctcctcctcagtaacgcgggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcaggtaaacaggaatttttctctggctacaaatactaaatattcagtatatatttatgtttattttcatacaaaactcacttctcaaaattctaaaagggtaagttgacccttcgtgacatgcttactagctggttttggagccagttggattagcttgctgtgagtcttaacttggcttgtatcatgtaatatacttctttttatttgtatgtggctagtgcatttttattggctttctactttctcattccacccttttcctaattaccagtgctgtgagagttttgaactctcacagttaaattttgagtttaacctaagagctcttaaaggaaagacaaatagaatacaataaaactgcagacgaactattggcaaaaacagccctcagggggttcctcagtcactcaacctgactgacaaaaaagatttgtgggcccgggggaagttaatgcttttaatgctgtgcatatataatgacttagagctagccactgagaaggcttctaattccaggcataaatggaaattgagttgattaacaaattgaagataggtaaaaatggtcccaagtaatagcatttctagtactattcatttctttggtaaggttttccagttatctattttctcagaatgaagggctaacacttttaaacaatttattttattttattttatttttttgagatggagtctctctctgtcgcccaggctggagngcagtggtgtgatctcggctcactgcagcctccctctcctgggttcnagcaattctcctgcctcagcctcccgagtagctnggactacaggcatgcacccccacacccggctaatttttctattttagtagagatggagtttcactgtgttgcctaggctgttctagaactcctgagctccggcgatccgcccacctcggcttcccataatgctnggattacaggcgcaagccatcgcacctggcccacaattttttttttaatatctcatcatttatcagtcaggaaacgaagcaaggcttgggctgagtgaattttctattctacagggtatccaaagaggtcctttgttggcatttaacaggccggtggacttggtctggagcatcccggattgcttctcgcacctgtctggcacctagtcaagctcaaagttaaagctagttcggagccttgcagtgtgtgaagaatctccaccaccccctgcaccagagatatcacaggagaaccaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggttctgagtcttctggtagtgtagggtcatctacaggctctctttctcacatccagcagcctcttccaggtacagctctcagccagtcttctcatggcgcacctgtcgtctatccaactgtcagcactcatagttctctttcctttgatggtggcctaaatgggcaagtcgcatctcctagcactagcttctttttgcttcccttggaagcggcaggcataccacctggcagtattctgatcaacccacaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacagcaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacagatgccagcctgttattgcgctccaggccactatcactccagccaacctcagtatcgcccagtcccttctgttcattacaattcacatctaaaccaaccactgccacaacctgcgcagcagacaggttatcaagttatacccaaccagcagcaaaactaccaaggaatagttggagttcagcaaccccagagtcagagcctagtcagtggccaacccaacagcattggaaatcagattcaaggagtggtcatcccctatacttcagtgccaacatatcaggtttcactgcctcaaggttctcaaggaattccccatcagacttatcaacagcctgttatgttccctaatcagtctaatcaaggatctatgcccacaacaggaatgcctgtttactatagtgtcattccacctggtcaacaaaacaatttaagctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaatataaaaaaaaaa

SEQ ID NO: 319349 - DNA, 4156 bp, Homo sapiens
gcgtggtgggaaggggcgggattctgccagccgcggctgccgctggagccggtgtccgggctggtgatggggttaattccctttcgtaagactcttacttgcacccacccagccccgccgtcgccccgccgcgccgcgctccaaccgcctcctcctcctcagtaacgcgggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggttctgagtcttctggtagtgtagggtcatctacaggctctctttctcacatccagcagcctcttccaggtacagctctcagccagtcttctcatggcgcacctgtcgtctatccaactgtcagcactcatagttctctttcctttgatggtggcctaaatgggcaagtcgcatctcctagcactagcttctttttgcttcccttggaagcggcaggcataccacctggcagtattctgatcaacccacaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacagcaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacagatgccagcctgttattgcgctccaggccactatcactccagccaacctcagtatcgcccagtcccttctgttcattacaattcacatctaaaccaaccactgccacaacctgcgcagcagacaggttatcaagttatacccaaccagcagcaaaactaccaaggaatagttggagttcagcaaccccagagtcagagcctagtcagtggccaacccaacagcattggaaatcagattcaaggagtggtcatcccctatacttcagtgccaacatatcaggtttcactgcctcaaggttctcaaggaattccccatcagacttatcaacagcctgttatgttccctaatcagtctaatcaaggatctatgcccacaacaggaatgcctgtttactatagtgtcattccacctggtcaacaaaacaatttaagctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaatataaaaaaaaaa

SEQ ID NO: 319350 - DNA, 2532 bp, Homo sapiens
agactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttatcaagttatacccaaccagcagcaaaactaccaaggaatagttggagttcagcaaccccagagtcagagcctagtcagtggccaacccaacagcattggaaatcagattcaaggagtggtcatcccctatacttcagtgccaacatatcaggtttcactgcctcaaggttctcaaggaattccccatcagacttatcaacagcctgttatgttccctaatcagtctaatcaaggatctatgcccacaacaggaatgcctgtttactatagtgtcattccacctggtcaacaaaacaatttaagctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaatataaaaaaaaaa

SEQ ID NO: 319351 - DNA, 1969 bp, Homo sapiens
ggaaggtgggactacaaaggggcacaaggcaactttgctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaatataaaaaaaaaa

SEQ ID NO: 319352 - DNA, 2128 bp, Homo sapiens
ctacctgttggcaggtgaatgacactatagtaaacaggcatcctgttgtgggcatagatccttgattagactgattagggaacataacaggctgttgataagtctgatggggaattccttgagaaccatgagtcttgctcgccagccatctgctgatggttctgaccctcatgccgccatgttccagtccactgtgctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaatataaaaaaaaaa

SEQ ID NO: 319353 - DNA, 1977 bp, Homo sapiens
tctcaagatcagtcattctccaggagcatcagagacatctttgtgctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaatataaaaaaaaaa

SEQ ID NO: 319354 - DNA, 3710 bp, Homo sapiens
  misc_feature (1301)..(1301): n is a, c, g, or t
  misc_feature (1348)..(1348): n is a, c, g, or t
  misc_feature (1382)..(1382): n is a, c, g, or t
  misc_feature (1516)..(1516): n is a, c, g, or t
agcggaggctgctctagcaggcactcccaatgccagactaatcagctggatgtgtgcagtgagctctatagaggagcaatgcagagcatcagtttacaggtactatggaaagaacatctccttaactctgtatgatgaagcaaataccaatacaatgaaggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcaggtaaacaggaatttttctctggctacaaatactaaatattcagtatatatttatgtttattttcatacaaaactcacttctcaaaattctaaaagggtaagttgacccttcgtgacatgcttactagctggttttggagccagttggattagcttgctgtgagtcttaacttggcttgtatcatgtaatatacttctttttatttgtatgtggctagtgcatttttattggctttctactttctcattccacccttttcctaattaccagtgctgtgagagttttgaactctcacagttaaattttgagtttaacctaagagctcttaaaggaaagacaaatagaatacaataaaactgcagacgaactattggcaaaaacagccctcagggggttcctcagtcactcaacctgactgacaaaaaagatttgtgggcccgggggaagttaatgcttttaatgctgtgcatatataatgacttagagctagccactgagaaggcttctaattccaggcataaatggaaattgagttgattaacaaattgaagataggtaaaaatggtcccaagtaatagcatttctagtactattcatttctttggtaaggttttccagttatctattttctcagaatgaagggctaacacttttaaacaatttattttattttattttatttttttgagatggagtctctctctgtcgcccaggctggagngcagtggtgtgatctcggctcactgcagcctccctctcctgggttcnagcaattctcctgcctcagcctcccgagtagctnggactacaggcatgcacccccacacccggctaatttttctattttagtagagatggagtttcactgtgttgcctaggctgttctagaactcctgagctccggcgatccgcccacctcggcttcccataatgctnggattacaggcgcaagccatcgcacctggcccacaattttttttttaatatctcatcatttatcagtcaggaaacgaagcaaggcttgggctgagtgaattttctattctacagggtatccaaagaggtcctttgttggcatttaacaggccggtggacttggtctggagcatcccggattgcttctcgcacctgtctggcacctagtcaagctcaaagttaaagctagttcggagccttgcagtgtgtgaagaatctccaccaccccctgcaccagagatatcacaggagaaccaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggttctgagtcttctggtagtgtagggtcatctacaggctctctttctcacatccagcagcctcttccaggtacagctctcagccagtcttctcatggcgcacctgtcgtctatccaactgtcagcactcatagttctctttcctttgatggtggcctaaatgggcaagtcgcatctcctagcactagcttctttttgcttcccttggaagcggcaggcataccacctggcagtattctgatcaacccacaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacagcaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacagatgccagcctgttattgcgctccaggccactatcactccagccaacctcagtatcgcccagtcccttctgttcattacaattcacatctaaaccaaccactgccacaacctgcgcagcagacaggttatcaagttatacccaaccagcagaaagaaaccaaggattgactatccccctgagtttcaccagagaccagggtatttaaaggatccacgataccaggaagtggacagacgattttcaggagttcgccgagatgtgtgtacaaatggg

SEQ ID NO: 319355 - DNA, 3193 bp, Homo sapiens
  misc_feature (1301)..(1301): n is a, c, g, or t
  misc_feature (1348)..(1348): n is a, c, g, or t
  misc_feature (1382)..(1382): n is a, c, g, or t
  misc_feature (1516)..(1516): n is a, c, g, or t
agcggaggctgctctagcaggcactcccaatgccagactaatcagctggatgtgtgcagtgagctctatagaggagcaatgcagagcatcagtttacaggtactatggaaagaacatctccttaactctgtatgatgaagcaaataccaatacaatgaaggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcaggtaaacaggaatttttctctggctacaaatactaaatattcagtatatatttatgtttattttcatacaaaactcacttctcaaaattctaaaagggtaagttgacccttcgtgacatgcttactagctggttttggagccagttggattagcttgctgtgagtcttaacttggcttgtatcatgtaatatacttctttttatttgtatgtggctagtgcatttttattggctttctactttctcattccacccttttcctaattaccagtgctgtgagagttttgaactctcacagttaaattttgagtttaacctaagagctcttaaaggaaagacaaatagaatacaataaaactgcagacgaactattggcaaaaacagccctcagggggttcctcagtcactcaacctgactgacaaaaaagatttgtgggcccgggggaagttaatgcttttaatgctgtgcatatataatgacttagagctagccactgagaaggcttctaattccaggcataaatggaaattgagttgattaacaaattgaagataggtaaaaatggtcccaagtaatagcatttctagtactattcatttctttggtaaggttttccagttatctattttctcagaatgaagggctaacacttttaaacaatttattttattttattttatttttttgagatggagtctctctctgtcgcccaggctggagngcagtggtgtgatctcggctcactgcagcctccctctcctgggttcnagcaattctcctgcctcagcctcccgagtagctnggactacaggcatgcacccccacacccggctaatttttctattttagtagagatggagtttcactgtgttgcctaggctgttctagaactcctgagctccggcgatccgcccacctcggcttcccataatgctnggattacaggcgcaagccatcgcacctggcccacaattttttttttaatatctcatcatttatcagtcaggaaacgaagcaaggcttgggctgagtgaattttctattctacagggtatccaaagaggtcctttgttggcatttaacaggccggtggacttggtctggagcatcccggattgcttctcgcacctgtctggcacctagtcaagctcaaagttaaagctagttcggagccttgcagtgtgtgaagaatctccaccaccccctgcaccagagatatcacaggagaaccaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacagacggagtctccctctggcgcccaggctggagtgcagtggcgcgacctcggctcactgcaagctccgcctcttggattcacgccattctcctgtctcagcctcccgagtagctgggctacaggcgcccgccaccatgcccggctaattttttgtattttttagtagagacggggtttcaccatgttagccaggatggtctcaatctcctgacctcgtgatccgcccgcctcggcctcccaaagtgctgggatatatttttttacccagagcttttttcttataaaattgctaaaagttaggggctttggtcccaaa

SEQ ID NO: 319356 - DNA, 3070 bp, Homo sapiens
  misc_feature (1301)..(1301): n is a, c, g, or t
  misc_feature (1348)..(1348): n is a, c, g, or t
  misc_feature (1382)..(1382): n is a, c, g, or t
  misc_feature (1516)..(1516): n is a, c, g, or t
agcggaggctgctctagcaggcactcccaatgccagactaatcagctggatgtgtgcagtgagctctatagaggagcaatgcagagcatcagtttacaggtactatggaaagaacatctccttaactctgtatgatgaagcaaataccaatacaatgaaggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcaggtaaacaggaatttttctctggctacaaatactaaatattcagtatatatttatgtttattttcatacaaaactcacttctcaaaattctaaaagggtaagttgacccttcgtgacatgcttactagctggttttggagccagttggattagcttgctgtgagtcttaacttggcttgtatcatgtaatatacttctttttatttgtatgtggctagtgcatttttattggctttctactttctcattccacccttttcctaattaccagtgctgtgagagttttgaactctcacagttaaattttgagtttaacctaagagctcttaaaggaaagacaaatagaatacaataaaactgcagacgaactattggcaaaaacagccctcagggggttcctcagtcactcaacctgactgacaaaaaagatttgtgggcccgggggaagttaatgcttttaatgctgtgcatatataatgacttagagctagccactgagaaggcttctaattccaggcataaatggaaattgagttgattaacaaattgaagataggtaaaaatggtcccaagtaatagcatttctagtactattcatttctttggtaaggttttccagttatctattttctcagaatgaagggctaacacttttaaacaatttattttattttattttatttttttgagatggagtctctctctgtcgcccaggctggagngcagtggtgtgatctcggctcactgcagcctccctctcctgggttcnagcaattctcctgcctcagcctcccgagtagctnggactacaggcatgcacccccacacccggctaatttttctattttagtagagatggagtttcactgtgttgcctaggctgttctagaactcctgagctccggcgatccgcccacctcggcttcccataatgctnggattacaggcgcaagccatcgcacctggcccacaattttttttttaatatctcatcatttatcagtcaggaaacgaagcaaggcttgggctgagtgaattttctattctacagggtatccaaagaggtcctttgttggcatttaacaggccggtggacttggtctggagcatcccggattgcttctcgcacctgtctggcacctagtcaagctcaaagttaaagctagttcggagccttgcagtgtgtgaagaatctccaccaccccctgcaccagagatatcacaggagaaccaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggttctgagtcttctggtagtgtagggtcatctacaggctctctttctcacatccagcagcctcttccaggtacagctctcagccagtcttctcatggcgcacctgtcgtctatccaactgtcagcactcatagttctctttcctttgatggtggcctaaatgggcaagtcgcatctcctagcactagcttctttttgcttcccttggaagcggcaggcataccacctggcagtattctgatcaacccacaaacaggttggtatccagaaaaaggtgtttcaggaattatctgaaaatttaaggatacttattaaatgtattttctgaatatgtgtagtcag

SEQ ID NO: 319357 - DNA, 251 bp, Homo sapiens
ctgtattctaagttatttttttccctctttttgaatttttcaggtcagcccttcataaacccagatgggagtccagttgtgtataatcctcctatgactcaacaaccagttagatcccaagtgcctggacctccacagccacctctgccagccccacctcaacaaccagcagctaatcacattttctcacaggtgcacatatccatgattacataatgctaagttgacttgcctttacatatttgggacta

SEQ ID NO: 319358 - DNA, 5799 bp, Homo sapiens
  misc_feature (1301)..(1301): n is a, c, g, or t
  misc_feature (1348)..(1348): n is a, c, g, or t
  misc_feature (1382)..(1382): n is a, c, g, or t
  misc_feature (1516)..(1516): n is a, c, g, or t
agcggaggctgctctagcaggcactcccaatgccagactaatcagctggatgtgtgcagtgagctctatagaggagcaatgcagagcatcagtttacaggtactatggaaagaacatctccttaactctgtatgatgaagcaaataccaatacaatgaaggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcaggtaaacaggaatttttctctggctacaaatactaaatattcagtatatatttatgtttattttcatacaaaactcacttctcaaaattctaaaagggtaagttgacccttcgtgacatgcttactagctggttttggagccagttggattagcttgctgtgagtcttaacttggcttgtatcatgtaatatacttctttttatttgtatgtggctagtgcatttttattggctttctactttctcattccacccttttcctaattaccagtgctgtgagagttttgaactctcacagttaaattttgagtttaacctaagagctcttaaaggaaagacaaatagaatacaataaaactgcagacgaactattggcaaaaacagccctcagggggttcctcagtcactcaacctgactgacaaaaaagatttgtgggcccgggggaagttaatgcttttaatgctgtgcatatataatgacttagagctagccactgagaaggcttctaattccaggcataaatggaaattgagttgattaacaaattgaagataggtaaaaatggtcccaagtaatagcatttctagtactattcatttctttggtaaggttttccagttatctattttctcagaatgaagggctaacacttttaaacaatttattttattttattttatttttttgagatggagtctctctctgtcgcccaggctggagngcagtggtgtgatctcggctcactgcagcctccctctcctgggttcnagcaattctcctgcctcagcctcccgagtagctnggactacaggcatgcacccccacacccggctaatttttctattttagtagagatggagtttcactgtgttgcctaggctgttctagaactcctgagctccggcgatccgcccacctcggcttcccataatgctnggattacaggcgcaagccatcgcacctggcccacaattttttttttaatatctcatcatttatcagtcaggaaacgaagcaaggcttgggctgagtgaattttctattctacagggtatccaaagaggtcctttgttggcatttaacaggccggtggacttggtctggagcatcccggattgcttctcgcacctgtctggcacctagtcaagctcaaagttaaagctagttcggagccttgcagtgtgtgaagaatctccaccaccccctgcaccagagatatcacaggagaaccaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggttctgagtcttctggtagtgtagggtcatctacaggctctctttctcacatccagcagcctcttccaggtacagctctcagccagtcttctcatggcgcacctgtcgtctatccaactgtcagcactcatagttctctttcctttgatggtggcctaaatgggcaagtcgcatctcctagcactagcttctttttgcttcccttggaagcggcaggcataccacctggcagtattctgatcaacccacaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacagcaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacagatgccagcctgttattgcgctccaggccactatcactccagccaacctcagtatcgcccagtcccttctgttcattacaattcacatctaaaccaaccactgccacaacctgcgcagcagacaggttatcaagttatacccaaccagcagcaaaactaccaaggaatagttggagttcagcaaccccagagtcagagcctagtcagtggccaacccaacagcattggaaatcagattcaaggagtggtcatcccctatacttcagtgccaacatatcaggtttcactgcctcaaggttctcaaggaattccccatcagacttatcaacagcctgttatgttccctaatcagtctaatcaaggatctatgcccacaacaggaatgcctgtttactatagtgtcattccacctggtcaacaaaacaatttaagctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaatataaaaaaaaaa

SEQ ID NO: 319359 - DNA, 2799 bp, Homo sapiens
tgctgttgttgatatatataatttccataatgtgtactattgcatcttatttaaaaataggaagtatttttctttgataagtttggcctatgtgtagaaggcttactaatttttgacttcttccttttttagccaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacagatgccagcctgttattgcgctccaggccactatcactccagccaacctcagtatcgcccagtcccttctgttcattacaattcacatctaaaccaaccactgccacaacctgcgcagcagacaggttatcaagttatacccaaccagcagcaaaactaccaaggaatagttggagttcagcaaccccagagtcagagcctagtcagtggccaacccaacagcattggaaatcagattcaaggagtggtcatcccctatacttcagtgccaacatatcaggtttcactgcctcaaggttctcaaggaattccccatcagacttatcaacagcctgttatgttccctaatcagtctaatcaaggatctatgcccacaacaggaatgcctgtttactatagtgtcattccacctggtcaacaaaacaatttaagctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaatataaaaaaaaaa

SEQ ID NO: 319360 - DNA, 5209 bp, Homo sapiens
  misc_feature (1301)..(1301): n is a, c, g, or t
  misc_feature (1348)..(1348): n is a, c, g, or t
  misc_feature (1382)..(1382): n is a, c, g, or t
  misc_feature (1516)..(1516): n is a, c, g, or t
agcggaggctgctctagcaggcactcccaatgccagactaatcagctggatgtgtgcagtgagctctatagaggagcaatgcagagcatcagtttacaggtactatggaaagaacatctccttaactctgtatgatgaagcaaataccaatacaatgaaggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcaggtaaacaggaatttttctctggctacaaatactaaatattcagtatatatttatgtttattttcatacaaaactcacttctcaaaattctaaaagggtaagttgacccttcgtgacatgcttactagctggttttggagccagttggattagcttgctgtgagtcttaacttggcttgtatcatgtaatatacttctttttatttgtatgtggctagtgcatttttattggctttctactttctcattccacccttttcctaattaccagtgctgtgagagttttgaactctcacagttaaattttgagtttaacctaagagctcttaaaggaaagacaaatagaatacaataaaactgcagacgaactattggcaaaaacagccctcagggggttcctcagtcactcaacctgactgacaaaaaagatttgtgggcccgggggaagttaatgcttttaatgctgtgcatatataatgacttagagctagccactgagaaggcttctaattccaggcataaatggaaattgagttgattaacaaattgaagataggtaaaaatggtcccaagtaatagcatttctagtactattcatttctttggtaaggttttccagttatctattttctcagaatgaagggctaacacttttaaacaatttattttattttattttatttttttgagatggagtctctctctgtcgcccaggctggagngcagtggtgtgatctcggctcactgcagcctccctctcctgggttcnagcaattctcctgcctcagcctcccgagtagctnggactacaggcatgcacccccacacccggctaatttttctattttagtagagatggagtttcactgtgttgcctaggctgttctagaactcctgagctccggcgatccgcccacctcggcttcccataatgctnggattacaggcgcaagccatcgcacctggcccacaattttttttttaatatctcatcatttatcagtcaggaaacgaagcaaggcttgggctgagtgaattttctattctacagggtatccaaagaggtcctttgttggcatttaacaggccggtggacttggtctggagcatcccggattgcttctcgcacctgtctggcacctagtcaagctcaaagttaaagctagttcggagccttgcagtgtgtgaagaatctccaccaccccctgcaccagagatatcacaggagaaccaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggttctgagtcttctggtagtgtagggtcatctacaggctctctttctcacatccagcagcctcttccaggtacagctctcagccagtcttctcatggcgcacctgtcgtctatccaactgtcagcactcatagttctctttcctttgatggtggcctaaatgggcaagtcgcatctcctagcactagcttctttttgcttcccttggaagcggcaggcataccacctggcagtattctgatcaacccacaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacagcaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacagatgccagcctgttattgcgctccaggccactatcactccagccaacctcagtatcgcccagtcccttctgttcattacaattcacatctaaaccaaccactgccacaacctgcgcagcagacaggttatcaagttatacccaaccagcagcaaaactaccaaggaatagttggagttcagcaaccccagagtcagagcctagtcagtggccaacccaacagcattggaaatcagattcaaggagtggtcatcccctatacttcagtgccaacatatcaggtttcactgcctcaaggttctcaaggaattccccatcagacttatcaacagcctgttatgttccctaatcagtctaatcaaggatctatgcccacaacaggaatgcctgtttactatagtgtcattccacctggtcaacaaaacaatttaagctcttcagtaggttacctgcaacatccaggatcagaacaagtacaatttcctcgaacctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaatataaaaaaaaaa

SEQ ID NO: 319361 - DNA, 2113 bp, Homo sapiens
aaagaaaacttgcattctatacctgtaaaaatatttttcagaaacagagatttcaaacacacaaaagctgaattaattgccagccacctcgcactgtgagaactgttaaaggaagtttttcagacagaaggaaaatgataccaatggaaattggtggtacacaaaagaatacaaataaaagctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaatataaaaaaaaaa

SEQ ID NO: 319362 - DNA, 5334 bp, Homo sapiens
  misc_feature (1301)..(1301): n is a, c, g, or t
  misc_feature (1348)..(1348): n is a, c, g, or t
  misc_feature (1382)..(1382): n is a, c, g, or t
  misc_feature (1516)..(1516): n is a, c, g, or t
agcggaggctgctctagcaggcactcccaatgccagactaatcagctggatgtgtgcagtgagctctatagaggagcaatgcagagcatcagtttacaggtactatggaaagaacatctccttaactctgtatgatgaagcaaataccaatacaatgaaggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcaggtaaacaggaatttttctctggctacaaatactaaatattcagtatatatttatgtttattttcatacaaaactcacttctcaaaattctaaaagggtaagttgacccttcgtgacatgcttactagctggttttggagccagttggattagcttgctgtgagtcttaacttggcttgtatcatgtaatatacttctttttatttgtatgtggctagtgcatttttattggctttctactttctcattccacccttttcctaattaccagtgctgtgagagttttgaactctcacagttaaattttgagtttaacctaagagctcttaaaggaaagacaaatagaatacaataaaactgcagacgaactattggcaaaaacagccctcagggggttcctcagtcactcaacctgactgacaaaaaagatttgtgggcccgggggaagttaatgcttttaatgctgtgcatatataatgacttagagctagccactgagaaggcttctaattccaggcataaatggaaattgagttgattaacaaattgaagataggtaaaaatggtcccaagtaatagcatttctagtactattcatttctttggtaaggttttccagttatctattttctcagaatgaagggctaacacttttaaacaatttattttattttattttatttttttgagatggagtctctctctgtcgcccaggctggagngcagtggtgtgatctcggctcactgcagcctccctctcctgggttcnagcaattctcctgcctcagcctcccgagtagctnggactacaggcatgcacccccacacccggctaatttttctattttagtagagatggagtttcactgtgttgcctaggctgttctagaactcctgagctccggcgatccgcccacctcggcttcccataatgctnggattacaggcgcaagccatcgcacctggcccacaattttttttttaatatctcatcatttatcagtcaggaaacgaagcaaggcttgggctgagtgaattttctattctacagggtatccaaagaggtcctttgttggcatttaacaggccggtggacttggtctggagcatcccggattgcttctcgcacctgtctggcacctagtcaagctcaaagttaaagctagttcggagccttgcagtgtgtgaagaatctccaccaccccctgcaccagagatatcacaggagaaccaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggttctgagtcttctggtagtgtagggtcatctacaggctctctttctcacatccagcagcctcttccaggtacagctctcagccagtcttctcatggcgcacctgtcgtctatccaactgtcagcactcatagttctctttcctttgatggtggcctaaatgggcaagtcgcatctcctagcactagcttctttttgcttcccttggaagcggcaggcataccacctggcagtattctgatcaacccacaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacagcaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacagatgccagcctgttattgcgctccaggccactatcactccagccaacctcagtatcgcccagtcccttctgttcattacaattcacatctaaaccaaccactgccacaacctgcgcagcagacaggttatcaagttatacccaaccagcagcaaaactaccaaggaatagttggagttcagcaaccccagagtcagagcctagtcagtggccaacccaacagcattggaaatcagattcaaggagtggtcatcccctatacttcagtgccaacatatcaggtttcactgcctcaaggttctcaaggaattccccatcagacttatcaacagcctgttatgttccctaatcagtctaatcaaggatctatgcccacaacaggaatgcctgtttactatagtgtcattccacctggtcaacaaaacaatttaagctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagtattggtgaaattctaatctgtataagatcaaggtctaatgtccagcaatatctcaaatgtttaccagtgccctgtattttttgagcagaaaagtgccacttaattgggcaagagaggggaaacagcaacaggtatcctggggtgggtagaagagcaaaaggagactcctatttagaaaacaaaaaatccgggggattagagggaaaaaaagtgccaaacgggaaggagaagtagaataggagatctatctgcca

SEQ ID NO: 319363 - DNA, 3612 bp, Homo sapiens
  misc_feature (1301)..(1301): n is a, c, g, or t
  misc_feature (1348)..(1348): n is a, c, g, or t
  misc_feature (1382)..(1382): n is a, c, g, or t
  misc_feature (1516)..(1516): n is a, c, g, or t
agcggaggctgctctagcaggcactcccaatgccagactaatcagctggatgtgtgcagtgagctctatagaggagcaatgcagagcatcagtttacaggtactatggaaagaacatctccttaactctgtatgatgaagcaaataccaatacaatgaaggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcaggtaaacaggaatttttctctggctacaaatactaaatattcagtatatatttatgtttattttcatacaaaactcacttctcaaaattctaaaagggtaagttgacccttcgtgacatgcttactagctggttttggagccagttggattagcttgctgtgagtcttaacttggcttgtatcatgtaatatacttctttttatttgtatgtggctagtgcatttttattggctttctactttctcattccacccttttcctaattaccagtgctgtgagagttttgaactctcacagttaaattttgagtttaacctaagagctcttaaaggaaagacaaatagaatacaataaaactgcagacgaactattggcaaaaacagccctcagggggttcctcagtcactcaacctgactgacaaaaaagatttgtgggcccgggggaagttaatgcttttaatgctgtgcatatataatgacttagagctagccactgagaaggcttctaattccaggcataaatggaaattgagttgattaacaaattgaagataggtaaaaatggtcccaagtaatagcatttctagtactattcatttctttggtaaggttttccagttatctattttctcagaatgaagggctaacacttttaaacaatttattttattttattttatttttttgagatggagtctctctctgtcgcccaggctggagngcagtggtgtgatctcggctcactgcagcctccctctcctgggttcnagcaattctcctgcctcagcctcccgagtagctnggactacaggcatgcacccccacacccggctaatttttctattttagtagagatggagtttcactgtgttgcctaggctgttctagaactcctgagctccggcgatccgcccacctcggcttcccataatgctnggattacaggcgcaagccatcgcacctggcccacaattttttttttaatatctcatcatttatcagtcaggaaacgaagcaaggcttgggctgagtgaattttctattctacagggtatccaaagaggtcctttgttggcatttaacaggccggtggacttggtctggagcatcccggattgcttctcgcacctgtctggcacctagtcaagctcaaagttaaagctagttcggagccttgcagtgtgtgaagaatctccaccaccccctgcaccagagatatcacaggagaaccaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggttctgagtcttctggtagtgtagggtcatctacaggctctctttctcacatccagcagcctcttccaggtacagctctcagccagtcttctcatggcgcacctgtcgtctatccaactgtcagcactcatagttctctttcctttgatggtggcctaaatgggcaagtcgcatctcctagcactagcttctttttgcttcccttggaagcggcaggcataccacctggcagtattctgatcaacccacaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacagcaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacagatgccagcctgttattgcgctccaggccactatcactccagccaacctcagtatcgcccagtcccttctgttcattacaattcacatctaaaccaaccactgccacaacctgcgcagcagacaggttatcaagttgtacccagaaccggggatggatcctctagatacctgcgtcc

SEQ ID NO: 319364 - DNA, 3268 bp, Homo sapiens
  misc_feature (1301)..(1301): n is a, c, g, or t
  misc_feature (1348)..(1348): n is a, c, g, or t
  misc_feature (1382)..(1382): n is a, c, g, or t
  misc_feature (1516)..(1516): n is a, c, g, or t
agcggaggctgctctagcaggcactcccaatgccagactaatcagctggatgtgtgcagtgagctctatagaggagcaatgcagagcatcagtttacaggtactatggaaagaacatctccttaactctgtatgatgaagcaaataccaatacaatgaaggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcaggtaaacaggaatttttctctggctacaaatactaaatattcagtatatatttatgtttattttcatacaaaactcacttctcaaaattctaaaagggtaagttgacccttcgtgacatgcttactagctggttttggagccagttggattagcttgctgtgagtcttaacttggcttgtatcatgtaatatacttctttttatttgtatgtggctagtgcatttttattggctttctactttctcattccacccttttcctaattaccagtgctgtgagagttttgaactctcacagttaaattttgagtttaacctaagagctcttaaaggaaagacaaatagaatacaataaaactgcagacgaactattggcaaaaacagccctcagggggttcctcagtcactcaacctgactgacaaaaaagatttgtgggcccgggggaagttaatgcttttaatgctgtgcatatataatgacttagagctagccactgagaaggcttctaattccaggcataaatggaaattgagttgattaacaaattgaagataggtaaaaatggtcccaagtaatagcatttctagtactattcatttctttggtaaggttttccagttatctattttctcagaatgaagggctaacacttttaaacaatttattttattttattttatttttttgagatggagtctctctctgtcgcccaggctggagngcagtggtgtgatctcggctcactgcagcctccctctcctgggttcnagcaattctcctgcctcagcctcccgagtagctnggactacaggcatgcacccccacacccggctaatttttctattttagtagagatggagtttcactgtgttgcctaggctgttctagaactcctgagctccggcgatccgcccacctcggcttcccataatgctnggattacaggcgcaagccatcgcacctggcccacaattttttttttaatatctcatcatttatcagtcaggaaacgaagcaaggcttgggctgagtgaattttctattctacagggtatccaaagaggtcctttgttggcatttaacaggccggtggacttggtctggagcatcccggattgcttctcgcacctgtctggcacctagtcaagctcaaagttaaagctagttcggagccttgcagtgtgtgaagaatctccaccaccccctgcaccagagatatcacaggagaaccaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggtataaatatctacacaaaactgtgcagtcaagtcattagttttcctaatgttgtctcaggtccttatttatcagatggcttctaattatcctaaaatataaaatcactatcaatagtaccttgaccacctccggagcacttaaggggtaatatgtttcttgacatgaggattcactctctgtcctggacacagatttacaaccatcaattaccataaaaattcttctctattgtgacataaacttaattaggtaggttcaatgaaacattatctcttgattgaatgcccataggtaattggaaattctttattacttattcgtagttggtagaaggcatggtttctcacctaggattatttaacactgattgcattttcagctaatactatcaattattgattgcattttttatgataaagtccttcattttccattaaaaaaattaaattgctgaggagattttgaggaatttaaaaaacaaaaacaagtaacttacaaatgactgaaaatttcaataatctcctcattctactacc

SEQ ID NO: 319365 - DNA, 2328 bp, Homo sapiens
  misc_feature (1311)..(1311): n is a, c, g, or t
  misc_feature (1358)..(1358): n is a, c, g, or t
  misc_feature (1392)..(1392): n is a, c, g, or t
  misc_feature (1526)..(1526): n is a, c, g, or t
  misc_feature (2190)..(2190): n is a, c, g, or t
  misc_feature (2194)..(2194): n is a, c, g, or t
  misc_feature (2269)..(2269): n is a, c, g, or t
  misc_feature (2305)..(2305): n is a, c, g, or t
gcgtggtgggaaggggcgggattctgccagccgcggctgccgctggagccggtgtccgggctggtgatggggttaattccctttcgtaagactcttacttgcacccacccagccccgccgtcgccccgccgcgccgcgctccaaccgcctcctcctcctcagtaacgcgggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcaggtaaacaggaatttttctctggctacaaatactaaatattcagtatatatttatgtttattttcatacaaaactcacttctcaaaattctaaaagggtaagttgacccttcgtgacatgcttactagctggttttggagccagttggattagcttgctgtgagtcttaacttggcttgtatcatgtaatatacttctttttatttgtatgtggctagtgcatttttattggctttctactttctcattccacccttttcctaattaccagtgctgtgagagttttgaactctcacagttaaattttgagtttaacctaagagctcttaaaggaaagacaaatagaatacaataaaactgcagacgaactattggcaaaaacagccctcagggggttcctcagtcactcaacctgactgacaaaaaagatttgtgggcccgggggaagttaatgcttttaatgctgtgcatatataatgacttagagctagccactgagaaggcttctaattccaggcataaatggaaattgagttgattaacaaattgaagataggtaaaaatggtcccaagtaatagcatttctagtactattcatttctttggtaaggttttccagttatctattttctcagaatgaagggctaacacttttaaacaatttattttattttattttatttttttgagatggagtctctctctgtcgcccaggctggagngcagtggtgtgatctcggctcactgcagcctccctctcctgggttcnagcaattctcctgcctcagcctcccgagtagctnggactacaggcatgcacccccacacccggctaatttttctattttagtagagatggagtttcactgtgttgcctaggctgttctagaactcctgagctccggcgatccgcccacctcggcttcccataatgctnggattacaggcgcaagccatcgcacctggcccacaattttttttttaatatctcatcatttatcagtcaggaaacgaagcaaggcttgggctgagtgaattttctattctacagggtatccaaagaggtcctttgttggcatttaacaggccggtggacttggtctggagcatcccggattgcttctcgcacctgtctggcacctaggtaggcaaggctgcagtgctgggctcaggtagaactagaagcacctatttatggctcctccaacaaggtgggtccaaagtagtcagacttcttatgtggcagctcaggggtcccagagagaatgttccaagaaagccaagcaaagctgcaaggtttcttttgacataggcccagaagttccagaacgttacttcagctatcttcttttgatgacataagtcaataaagccaggccagaggatggggaattagaccctacctctcagtaggaaagaatttgtagccacctttaagctaccacaaaaagttattcaaaaaaaaattgtttaggccgggagcgatggctgtaatcccagcactttgggagaccgaggtgagtggatcacaaggtcaggagatcgagaccatcctgaccaacatggtgaaaccctgtctctagtaaaaatacaaaaaattngccnggcatggttgcgcgcacctatagtcccagctatcctgaggcaggggaatcactcgaacccgggaggcagaggttncagtgagccaagatcgcaccactgcactccagcctngtgacagagcaagactccatctc

SEQ ID NO: 319366 - DNA, 452 bp, Homo sapiens
tctgtttgcaggttcccattttttcttcggaatgtaagctctaggagggcagaaattttgactgttgtgtccatagtactatgtatatggtaggcactgaacaagtatttgctgaatgaataaataaataatacattgtaaatgtctttttaaataaatgccaacataggctgggcacggtgcctcacacctgtaaccccacttctttgggaggccaaggcgggaggatcgcttgagcccaggaattccagatcaccctgggcaacatggtgaaaccccatctctgtaaaaaatacaaaaattaactggacatggtggcacatgcctatagacccagctacttgggaggctgaggtgggagggtcacttgagcccaggaggttgaggctgcggtgagccatgattgccccactgccctccagctcgggtgatgcagtgagacccttgtctca

SEQ ID NO: 319367 - DNA, 435 bp, Homo sapiens
atggatttatattacaaaatataagacctattatagaactgtagcatttaagatagtgtagtattggtgagaggttagatagcagtaaatcaatggaacagaatagagattccagaagcagacccatgcttactggtcatcttatttatgacaaagatgacactgtggtgcagtgggaaaataattttttcccccagcaagaactgcaaggtcaattggatagccttatggaaaaaaaaatgaatcttgactctttcatcacaacatacatgaaaatcaattctagatgaattgcaaatctaggtgtaaaggttaaaaacaaaatcttctaaaataggggttggcaaacttttcttgaagtgcccaatattaaatatttcaggctttgcatatcctacaatctctgttgcaattattcaactctcttccatggta

SEQ ID NO: 319368 - DNA, 288 bp, Homo sapiens
tattgtgttcaagcatcagcttggctggtgctgaggactcttttgatgatgaagtaataaaatggattcaaaatcacttggcatatgtatgtgcatgtacatctgtgtgtgcgtgtgtgtgagtgtgtgtgtgtgcatgcgtgtgagtgtgtgtgtatacgtgtatatgtttaaaggccatataaatgctaaactctgtgtgcaaatgtcctcgaattctgattccaactgtctttatcgagtgctggttgtttatccaggtgaaagcatccgctggccagttttgtc

SEQ ID NO: 319369 - DNA, 95 bp, Homo sapiens
gatcaaccagctgcttgcaggaagctgccagagagctgccgcttcagttaataacgggggtttttatttaagaaataaaaagaaatgtttgcgag

SEQ ID NO: 319370 - DNA, 851 bp, Homo sapiens
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcag

SEQ ID NO: 319371 - DNA, 1289 bp, Homo sapiens
taggtttgaactgactttattattttgtaaatgtgaattttacaaagcgctttacaattaatgatcacatccttttgtttgtcatggatttccactgtctgaaacggctctgagcacgcttgaagccctcggtttccctgttcgcttttgaatgtttcagttttagttattgatacaatgtcagccatggctaaaaagtaacagtcttgactctaccgagtaacagcacaaaaacagagtgagggctcaggaaaacaaaacaaaggcttcctccttaaaaaaaagacaaaaaaaaaaagctaagcatctgtggctgaaatctaactcagtggtactgtgaaaccttcctttacagcacaggaaaatttattttttaacagtcgtgagttacagtactttaacccctaaacagactctttaaaacaaccgtctcctttttaaaagtctcttttttccaaacattccatccgaaggatggatgctctacttgcacccagtgccatccaaatgttcaagtcaaaaatatttatacattttatacttatctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcag

SEQ ID NO: 319372 - DNA, 1103 bp, Homo sapiens
taggtttgaactgactttattattttgtaaatgtgaattttacaaagcgctttacaattaatgatcacatccttttgtttgtcatggatttccactgtctgaaacggctctgagcacgcttgaagccctcggtttccctgttcgcttttgaatgtttcagttttagttattgatacaatgtcagccatggctaaaaagtaacagtcttgactctaccgagtaacagcacaaaaacagagtgagggctcaggaaaacaaaacaaaggcttcctccttaaaaaaaagacaaaaaaaaaaagctaagcatctgtggctgaaatctaactcagtggtactgtgaaaccttcctttacagcacaggaaaatttattttttaacagtcgtgagttacagtactttaacccctaaacagactctttaaaacaaccgtctcctttttaaaagtctcttttttccaaacattccatccgaaggatggatgctctacttgcacccagtgccatccaaatgttcaagtcaaaaatatttatacattttatacttatctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgat

SEQ ID NO: 319373 - DNA, 610 bp, Homo sapiens
taactccttcaatgaatcttgttagtgggagaatatgggtttatattaatacgtggtttggcttaataaagtagttaaattttggaagtgtgttataaaatgatggagaaaatccagtgccatattcactttgtagtacatactgggtttcattgatttggatccattaacagttgattttctttcttacagagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcag

SEQ ID NO: 319374 - DNA, 423 bp, Homo sapiens
actcctgagtgtaaaacaacggcccgggagcactgtaaccgtgcagcgagttgcttatttacactagagatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgat

SEQ ID NO: 319375 - DNA, 424 bp, Homo sapiens
taactccttcaatgaatcttgttagtgggagaatatgggtttatattaatacgtggtttggcttaataaagtagttaaattttggaagtgtgttataaaatgatggagaaaatccagtgccatattcactttgtagtacatactgggtttcattgatttggatccattaacagttgattttctttcttacagagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgat

SEQ ID NO: 319376 - DNA, 2339 bp, Homo sapiens
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagcctgagtgtgaaagttaatggaggcctgggaacagggtttatactaagtagtggaggagcgtatggttaagcccaaaggggcagaacaagaaagccacgggattgtatgaaatcaaacatgagtttgtggtgtagactgctgtatgcagttggaaaggacacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagacggagggagaagagccaaggacaaggtcaggttgaatgagtaggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaaacaataaatactgattattggccataaagtggtattaaaactggatctcttttcttccatggcactactctcattttgaagtttatgaacggtacgacagtgtattgtaaattccctttagtttgttacagtagccaattgaaaatgtatatcccaaaatttaaaaaaaaaagtactagcagcaataaaattgcactagttttatctggtacatacaaaaacagccatttaaaatctgatgattctgtggaattggtgtccctgttagcaatggcagagaccagcctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaaccctatgatttactatgcagatgaagagggtaggaactaaataaaggactttgtaagccaaagtggttgggctgctttgtcaaattccaccctttgcttggttccaacatggaatttctcctttaaagatttcaatatcccatcaaaagtacagttagagaatacctagtgaatttattgaatataatgctaagaatcaaaagacttgtactagtttacctctggctttggtaagtgtggctttgagtaataactgagctgtttccccgcatataaaatagaaataaataagtagtcatcatgacaaaaaaaaaa

SEQ ID NO: 319377 - DNA, 2388 bp, Homo sapiens
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagcctgagtgtgaaagttaatggaggcctgggaacagggtttatactaagtagtggaggagcgtatggttaagcccaaaggggcagaacaagaaagccacgggattgtatgaaatcaaacatgagtttgtggtgtagactgctgtatgcagttggaaaggacacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagacggagggagaagagccaaggacaaggtcaggttgaatgagtaggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaaacaataaatactgattattggccataaagtggtattaaaactggatctcttttcttccatggcactactctcattttgaagtttatgaacggtacgacagtgtattgtaaattccctttagtttgttacagtagccaattgaaaatgtatatcccaaaatttaaaaaaaaaagtactagcagcaataaaattgcactagttttatctggtacatacaaaaacagccatttaaaatctgatgattctgtggaattggtgtccctgttagcaatggcagagaccagcctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaaccctatgatttactatgcagatgaagagggtaggaactaaataaaggactttgtaagccaaaaaaaagaaaggacgcacacacaccaaccgacaccatagaatagctagacgaaactagacaagaagggggggcgcactaagaaatagataccagagggggccacacaattgcagcacaacacgcgtattacgcaaaaaggggcccccaatgaagtggagccagttataagtagacgacacagcgggccggtgtcaagaaaccgggcgagcggagaacacgagtcagtagggacgatttgaggagagacaccctctgcgcggcggacaaatgagaaagcaccaggagattagacccgggcatat

SEQ ID NO: 319378 - DNA, 2025 bp, Homo sapiens
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagcctgagtgtgaaagttaatggaggcctgggaacagggtttatactaagtagtggaggagcgtatggttaagcccaaaggggcagaacaagaaagccacgggattgtatgaaatcaaacatgagtttgtggtgtagactgctgtatgcagttggaaaggacacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagacggagggagaagagccaaggacaaggtcaggttgaatgagtaggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaaacaataaatactgattattggccataaagtggtattaaaactggatctcttttcttccatggcactactctcattttgaagtttatgaacggtacgacagtgtattgtaaattccctttagtttgttacagtagccaattgaaaatgtatatcccaaaatttaaaaaaaaaagtactagcagcaataaaattgcactagttttatctggtacatacaaaaacacctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaaccctatgatttactatgcagatgaagagggtaggaactaaataaaggactttgtaagccaaa

SEQ ID NO: 319379 - DNA, 675 bp, Homo sapiens
accgaagcgctcgctcggataagattgccatcagctgtctacctggtttacaacaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcag

SEQ ID NO: 319380 - DNA, 2057 bp, Homo sapiens
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagcctgagtgtgaaagttaatggaggcctgggaacagggtttatactaagtagtggaggagcgtatggttaagcccaaaggggcagaacaagaaagccacgggattgtatgaaatcaaacatgagtttgtggtgtagactgctgtatgcagttggaaaggacacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagacggagggagaagagccaaggacaaggtcaggttgaatgagtaggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaaacaataaatactgattattggccataaagtggtattaaaactggatctcttttcttccatggcactactctcattttgaagtttatgaacggtacgacagtgtattgtaaattccctttagtttgttacagtagccaattgaaaatgtatatcccaaaatttaaaaaaaaaagtactagcagcaataaaattgcactagttttatctggtacatacaaaaacagccatttaaaatctgatgattctgtggaattggtgtccctgttagcaatggcagagaccagcctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaaccctatgatttactatgcagatgaagagggtaggaactaaataaaggactttgtaagccaaa

SEQ ID NO: 319381 - DNA, 603 bp, Homo sapiens
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttacta

SEQ ID NO: 319382 - DNA, 1829 bp, Homo sapiens
ccacctttcccctcaccagtaccaccataaaaaacacaaaacagaaacgctggttaggtacgcaaccttgactaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagcctgagtgtgaaagttaatggaggcctgggaacagggtttatactaagtagtggaggagcgtatggttaagcccaaaggggcagaacaagaaagccacgggattgtatgaaatcaaacatgagtttgtggtgtagactgctgtatgcagttggaaaggacacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagacggagggagaagagccaaggacaaggtcaggttgaatgagtaggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaaacaataaatactgattattggccataaagtggtattaaaactggatctcttttcttccatggcactactctcattttgaagtttatgaacggtacgacagtgtattgtaaattccctttagtttgttacagtagccaattgaaaatgtatatcccaaaatttaaaaaaaaaagtactagcagcaataaaattgcactagttttatctggtacatacaaaaacagccatttaaaatctgatgattctgtggaattggtgtccctgttagcaatggcagagaccagcctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaaccctatgatttactatgcagatgaagagggtaggaactaaataaaggactttgtaagccaaa

SEQ ID NO: 319383 - DNA, 791 bp, Homo sapiens
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcag

SEQ ID NO: 319384 - DNA, 1690 bp, Homo sapiens
actcactgacggagaagcagtggctcaaggccatcgagaagggcacgctggaggagatcgtaagaggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagcctgagtgtgaaagttaatggaggcctgggaacagggtttatactaagtagtggaggagcgtatggttaagcccaaaggggcagaacaagaaagccacgggattgtatgaaatcaaacatgagtttgtggtgtagactgctgtatgcagttggaaaggacacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagacggagggagaagagccaaggacaaggtcaggttgaatgagtaggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaaacaataaatactgattattggccataaagtggtattaaaactggatctcttttcttccatggcactactctcattttgaagtttatgaacggtacgacagtgtattgtaaattccctttagtttgttacagtagccaattgaaaatgtatatcccaaaatttaaaaaaaaaagtactagcagcaataaaattgcactagttttatctggtacatacaaaaacagccatttaaaatctgatgattctgtggaattggtgtccctgttagcaatggcagagaccagcctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaaccctatgatttactatgcagatgaagagggtaggaactaaataaaggactttgtaagccaaa

SEQ ID NO: 319385 - DNA, 728 bp, Homo sapiens
  misc_feature (631)..(631): n is a, c, g, or t
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactaagcttgtcagttctttcaaagttgcatncatccaagtgtagatctgcaactcgctggacggtacatttccccgggagaactcgtccattcggtggtggcggccgttattggtggtgaaggtcgac

SEQ ID NO: 319386 - DNA, 1096 bp, Homo sapiens
  misc_feature (17)..(17): n is a, c, g, or t
tccccgtgtctatcgantgccacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagacggagggagaagagccaaggacaaggtcaggttgaatgagtaggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaaacaataaatactgattattggccataaagtggtattaaaactggatctcttttcttccatggcactactctcattttgaagtttatgaacggtacgacagtgtattgtaaattccctttagtttgttacagtagccaattgaaaatgtatatcccaaaatttaaaaaaaaaagtactagcagcaataaaattgcactagttttatctggtacatacaaaaacagccatttaaaatctgatgattctgtggaattggtgtccctgttagcaatggcagagaccagcctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaaccctatgatttactatgcagatgaagagggtaggaactaaataaaggactttgtaagccaaa

SEQ ID NO: 319387 - DNA, 796 bp, Homo sapiens
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttgagtcttgctctgtcatccaggctggagtgcagtggcgcgatctcggctcactgcaacctctgcctcccaggtataagcgattctcctgcctcagcctcctgagtagctgggattacaggcgtgcaccaaacttcctttcatgcacacaattacttaaaatgatgtataaaattgtattccagctgtgtataaggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttacta

SEQ ID NO: 319388 - DNA, 1068 bp, Homo sapiens
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggtgaggagggcggggtggcctcagggacccgggccgggaacctggaacaacagttaattgcctttgccagtgtagagttattctccctgatttcaatttcatttctccacttggggccttcggactcagctttcaggaagttagaagtttttgttgttaggtgaaaggagatttgcccgtattgtaacgcttttgtgattaatgttgcaacttttgggcggttaagaatggacagacccaagattgctgtcactgttatggctgctaggtacaaaagtgataggtagataaatatgttgtagtatctgccctaaagggactcatagtcaaataaattgcactaggacaacatggtaagggagagtgatgctgtcgagtggtatttgttattctcaaagagcatttccacataatattaagccttaggtaccaaagcaccaaaagtgaaaaataaactaccaaaacccgagttatttcttctctaagggttattggaaaagcttttgatatgtgtttagtgaagatggttcctgaatgtttatctcttgggtgtacctccctacaaactactgtgggcttgtctttagcgctgcacataactccttggattgacaccataatggctttttagtataagtaaaaggtgtgtaattgaaaaatatgtgtatatactctactctgtctcaaaatatatatgtgtgtgcctatataacaaaatttgccgtgttaaccatttatttttattttttgaatctcac

SEQ ID NO: 319389 - DNA, 994 bp, Homo sapiens
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctccccgggaacctggaacaacagttaattgcctttgccagtgtagagttattctccctgatttcaatttcatttctccacttggggccttcggactcagctttcaggaagttagaagtttttgttgttaggtgaaaggagatttgcccgtattgtaacgcttttgtgattaatgttgcaacttttgggcggttaagaatggacagacccaagattgctgtcactgttatggctgctaggtacaaaagtgataggtagataaatatgttgtagtatctgccctaaagggactcatagtcaaataaattgcactaggacaacatggtaagggagagtgatgctgtcgagtggtatttgttattctcaaagagcatttccacataatattaagccttaggtaccaaagcaccaaaagtgaaaaataaactaccaaaacccgagttatttcttctctaagggttattggaaaagcttttgatatgtgtttagtgaagatggttcctgaatgtttatctcttgggtgtacctccctacaaactactgtgggcttgtctttagcgctgcacataactccttggattgacaccataatggctttttagtataagtaaaaggtgtgtaattgaaaaatatgtgtatatactctactctgtctcaaaatatatatgtgtgtgcctatataacaaaatttgccgtgttaaccatttatttttattttttgaatctcac

SEQ ID NO: 319390 - DNA, 665 bp, Homo sapiens
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgat

SEQ ID NO: 319391 - DNA, 425 bp, Homo sapiens
  misc_feature (18)..(20): n is a, c, g, or t
  misc_feature (28)..(28): n is a, c, g, or t
  misc_feature (34)..(34): n is a, c, g, or t
  misc_feature (69)..(69): n is a, c, g, or t
gacgctgctctagagatnnncaattcgncccggncaatgtaccgtccagcgagttgcagatctacactnggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgat

SEQ ID NO: 319392 - DNA, 2086 bp, Homo sapiens
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagcctgagtgtgaaagttaatggaggcctgggaacagggtttatactaagtagtggaggagcgtatggttaagcccaaaggggcagaacaagaaagccacgggattgtatgaaatcaaacatgagtttgtggtgtagactgctgtatgcagttggaaaggacacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagacggagggagaagagccaaggacaaggtcaggttgaatgagtaggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaaacaataaatactgattattggccataaagtggtattaaaactggatctcttttcttccatggcactactctcattttgaagtttatgaacggtacgacagtgtattgtaaattccctttagtttgttacagtagccaattgaaaatgtatatcccaaaatttaaaaaaaaaagtactagcagcaataaaattgcactagttttatctggtacatacaaaaacagccatttaaaatctgatgattctgtggaattggtgtccctgttagcaatggcagagaccagcctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaaccctatgatttactatgcagatgaagagggtaggaactaaataaaggactttgtaagccaaa

SEQ ID NO: 319393 - DNA, 2270 bp, Homo sapiens
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagcctgagtgtgaaagttaatggaggcctgggaacagggtttatactaagtagtggaggagcgtatggttaagcccaaaggggcagaacaagaaagccacgggattgtatgaaatcaaacatgagtttgtggtgtagactgctgtatgcagttggaaaggacacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagacggagggagaagagccaaggacaaggtcaggttgaatgagtaggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaaacaataaatactgattattggccataaagtggtattaaaactggatctcttttcttccatggcactactctcattttgaagtttatgaacggtacgacagtgtattgtaaattccctttagtttgttacagtagccaattgaaaatgtatatcccaaaatttaaaaaaaaaagtactagcagcaataaaattgcactagttttatctggtacatacaaaaacagccatttaaaatctgatgattctgtggaattggtgtccctgttagcaatggcagagaccagcctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaaccctatgatttactatgcagatgaagagggtaggaactaaataaaggactttgtaagccaaaaaaaaaaaaaaaaaaaaaaaaaaaaaaaaaaaaaaaaaaaagaaaaaaaaaaaaaacagacaaaagcataacccaaagaaagaaaaaaaaacagagagaaacacaaaacatcaaaacgcacacacgactctcagaaagaacacacaaacacagggaggaaggcgcagcaccaatacaggcgagg

SEQ ID NO: 319394 - DNA, 1053 bp, Homo sapiens
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagaaaaaaaaaaaaaaacttcaagtcgacggtatcgattagcttgatatcgaggtttttcttttttttcttggacttaaattacataccgttaagatacccattttaattaatttgactttttatgaccacttagaaaaccaccttcttaaggggtgcttctaggattaccatttggctccaggaaacttgctcaaggtccctc

SEQ ID NO: 319395 - DNA, 1110 bp, Homo sapiens
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagagcaaacccgagtcacaccggtgggaggtcaatgcccgtcttcccagactttaagatggtggatcactcatggggcccaaggtggaccttggactcaaaaccaagcccccagggacacgaggggtgacaatgagatgcggaaatgcagggctcaggccctgaataagggggcagcaggaagaaggacagggacacacattggggcaataacaggccggaaacacgacacgcaacaagaagcggacagcagcgagaagga

SEQ ID NO: 319396 - DNA, 1072 bp, Homo sapiens
  misc_feature (1072)..(1072): n is a, c, g, or t
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgataaaaaaaaaaaaaaaaaaaaaaaaaaaaaaaaaaaaaaaaagggggggggggggaaataatcaagggggggacaaggggcaaccacactttctgtgagcaaagcggcccagatgaggagtacaaacagaccagcagcagcgccgctgtcaaccaacgatgtgcagggacaagccctccttggcaacgtggggcgcaccccctatccgggcgcgacaatagcgcaccacaagacagatgccgctggataataaactgaggtgatgggtcacacgccatgtcgcgaaagttctctgttttgattaccgagacaataaacagcgcgcgatagtcaagagacagagagcacgtcagaagaaggacacgaatgagaatgagacaggcgcgccgctgctaacaacatgtcacn

SEQ ID NO: 319397 - DNA, 1107 bp, Homo sapiens
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgatccaacaatcttcagggaagcctcttttttttttttaaatatcccaatagaaaaaaaatggcgggcttttataaagaatgggtaaatcaaaaaaaataatattaatcagagattgtcctccaaatgaaatgcatggttggtagaaaataggaccctgggaaaatctcctaactctttctctcacagatatgtgtgactcagagaagacagcacgaaaagccctgctgcgcaaaagtgatgaacaaatttagtggccaaaatattccacactcaattggagtgacaaaaagccccatagtgaaatttctgattgtcaaacaaaaatttatctatattatccagagagaaaaccccccaattcagattcacatcatacttctccgtgtatgtccataaatgctgaaaagtaggggagaaatctctaaggccctgaagattgtggg

SEQ ID NO: 319398 - DNA, 498 bp, Homo sapiens
tcgtgtaataaactctaaaataataccccagtcccccagcgacatccggccattatggccgaggagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagaaagaagggcactcacttcaattttgcaatcgtttttacagatgttaaaagacctggctatcgagttaaggagattggcagctcgcccctgagttagcagctcgcccctgagttagcagctcgccgtt

SEQ ID NO: 319399 - DNA, 2118 bp, Homo sapiens
cgccctccggccgcggagctggaaaccgggctccgcgcgtccggggcggctggcggcgcgggcaggcaggcggggaggacaggctgggggcggcgaccgcgaggggccgcgcgcggagggcgcctggtgcagcatgggcggcccgcgggcttgggcgctgctctgcctcgggctcctgctcccgggaggcggcgctgcgtggagcatcggggcagctccgttctccggacgcaggaactggtgctcctatgtggtgacccgcaccatctcatgccatgtgcagaatggcacctaccttcagcgagtgctgcagaactgcccctggcccatgagctgtccggggagcagctacagaactgtggtgagacccacatacaaggtgatgtacaagatagtgaccgcccgtgagtggaggtgctgccctgggcactcaggagtgagctgcgaggaagttgcaggttcctctgcctccttggagcccatgtggtcgggcagtaccatgcggcggatggcgcttcggcccacagccttctcaggttgtctcaactgcagcaaagtgtcagagctgacagagcggctgaaggtgctggaggccaagatgaccatgctgactgtcatagagcagccagtacctccaacaccagctacccctgaggaccctgccccgctctggggtccccctcctgcccagggcagccccggagatggaggcctccaggaccaagtcggtgcttgggggcttcccgggcccaccggccccaagggagatgccggcagtcggggcccaatggggatgagaggcccaccaggtccacagggccccccagggagccctggccgggctggagctgtgggcacccctggagagaggggacctcctgggccaccagggcctcctggcccccctgggcccccagcccctgttgggccaccccatgcccggatctcccagcatggagacccattgctgtccaacaccttcactgagaccaacaaccactggccccagggacccactgggcctccaggccctccagggcccatgggtccccctgggcctcctggccccacaggtgtccctgggagtcctggtcacataggacccccaggccccactggacccaaaggaatctctggccacccaggagagaagggcgagagaggactgcgtggggagcctggcccccaaggctctgctgggcagcggggggaacctggccctaagggagaccctggtgagaagagccactggggggaggggttgcaccagctacgcgaggctttgaagattttagctgagagggttttaatcttggaaacaatgattgggctctatgaaccagagctggggtctggggcgggccctgccggcacaggcacccccagcctccttcggggcaagaggggcggacatgcaaccaactaccggatcgtggcccccaggagccgggacgagagaggctgagggtggtggcggcccctgaggcagaccaggccaggcttcccctcctacctggactcggccagctgcctccagggaccgcccgtccatatttattaatgtcctcagggtcccttctgccatctaggccttaggggtaagcaggtctcagtcctggcaccatgcacatgtctgaggctgagcaagggctgagaggagaggcttgggcctcagtttccctctgtgaagtggggggaggcaggccttcaaggagggatagaggtacaaggcttcgtctcatctgctgtctgagcatccaggcccaaaggcactgagggagtcaggagctggggctcggcacatgcagagatgacagggcagggggcagtcttcctccccctccccgaccaaacctcggggagccctcctgtgcccctccctccttgttgtccagtgctgggttccccaccccgaggtcaggctgcccaatcctctgactggatcaccgggggcttcttgcctcagttcttccctctgagcccccaggccctcccgcatctcaggttggggatggggacatggagaggaaggggccgcctactcctgcaaatgcttgtgacagatgccaggaggtagatgtgtgctggccaataaaggcccctacctgattccccgca

SEQ ID NO: 319400 - DNA, 2175 bp, Homo sapiens
cgccctccggccgcggagctggaaaccgggctccgcgcgtccggggcggctggcggcgcgggcaggcaggcggggaggacaggctgggggcggcgaccgcgaggggccgcgcgcggagggcgcctggtgcagcatgggcggcccgcgggcttgggcgctgctctgcctcgggctcctgctcccgggaggcggcgctgcgtggagcatcggggcagctccgttctccggacgcaggaactggtgctcctatgtggtgacccgcaccatctcatgccatgtgcagaatggcacctaccttcagcgagtgctgcagaactgcccctggcccatgagctgtccggggagcagctacagaactgtggtgagacccacatacaaggtgatgtacaagatagtgaccgcccgtgagtggaggtgctgccctgggcactcaggagtgagctgcgaggaagttgcaggttcctctgcctccttggagcccatgtggtcgggcagtaccatgcggcggatggcgcttcggcccacagccttctcaggttgtctcaactgcagcaaagtgtcagagctgacagagcggctgaaggtgctggaggccaagatgaccatgctgactgtcatagagcagccagtacctccaacaccagctacccctgaggaccctgccccgctctggggtccccctcctgcccagggcagccccggagatggaggcctccaggggctgccaggagccatagagagtgtgagggtcccgctgcttccccgaaatgaccaagtcggtgcttgggggcttcccgggcccaccggccccaagggagatgccggcagtcggggcccaatggggatgagaggcccaccaggtccacagggccccccagggagccctggccgggctggagctgtgggcacccctggagagaggggacctcctgggccaccagggcctcctggcccccctgggcccccagcccctgttgggccaccccatgcccggatctcccagcatggagacccattgctgtccaacaccttcactgagaccaacaaccactggccccagggacccactgggcctccaggccctccagggcccatgggtccccctgggcctcctggccccacaggtgtccctgggagtcctggtcacataggacccccaggccccactggacccaaaggaatctctggccacccaggagagaagggcgagagaggactgcgtggggagcctggcccccaaggctctgctgggcagcggggggaacctggccctaagggagaccctggtgagaagagccactgggctcctagcttacagagcttcctgcagcagcaggctcagctggagctcctggccagacgggtcaccctcctggaagccatcatctggccagaaccagagctggggtctggggcgggccctgccggcacaggcacccccagcctccttcggggcaagaggggcggacatgcaaccaactaccggatcgtggcccccaggagccgggacgagagaggctgagggtggtggcggcccctgaggcagaccaggccaggcttcccctcctacctggactcggccagctgcctccagggaccgcccgtccatatttattaatgtcctcagggtcccttctgccatctaggccttaggggtaagcaggtctcagtcctggcaccatgcacatgtctgaggctgagcaagggctgagaggagaggcttgggcctcagtttccctctgtgaagtggggggaggcaggccttcaaggagggatagaggtacaaggcttcgtctcatctgctgtctgagcatccaggcccaaaggcactgagggagtcaggagctggggctcggcacatgcagagatgacagggcagggggcagtcttcctccccctccccgaccaaacctcggggagccctcctgtgcccctccctccttgttgtccagtgctgggttccccaccccgaggtcaggctgcccaatcctctgactggatcaccgggggcttcttgcctcagttcttccctctgagcccccaggccctcccgcatctcaggttggggatggggacatggagaggaaggggccgcctactcctgcaaatgcttgtgacagatgccaggaggtagatgtgtgctggccaataaaggcccctacctgattccccgca

SEQ ID NO: 319401 - DNA, 2040 bp, Homo sapiens
cgccctccggccgcggagctggaaaccgggctccgcgcgtccggggcggctggcggcgcgggcaggcaggcggggaggacaggctgggggcggcgaccgcgaggggccgcgcgcggagggcgcctggtgcagcatgggcggcccgcgggcttgggcgctgctctgcctcgggctcctgctcccgggaggcggcgctgcgtggagcatcggggcagctccgttctccggacgcaggaactggtgctcctatgtggtgacccgcaccatctcatgccatgtgcagaatggcacctaccttcagcgagtgctgcagaactgcccctggcccatgagctgtccggggagcagctacagaactgtggtgagacccacatacaaggtgatgtacaagatagtgaccgcccgtgagtggaggtgctgccctgggcactcaggagtgagctgcgaggaaggttgtctcaactgcagcaaagtgtcagagctgacagagcggctgaaggtgctggaggccaagatgaccatgctgactgtcatagagcagccagtacctccaacaccagctacccctgaggaccctgccccgctctggggtccccctcctgcccagggcagccccggagatggaggcctccaggaccaagtcggtgcttgggggcttcccgggcccaccggccccaagggagatgccggcagtcggggcccaatggggatgagaggcccaccaggtccacagggccccccagggagccctggccgggctggagctgtgggcacccctggagagaggggacctcctgggccaccagggcctcctggcccccctgggcccccagcccctgttgggccaccccatgcccggatctcccagcatggagacccattgctgtccaacaccttcactgagaccaacaaccactggccccagggacccactgggcctccaggccctccagggcccatgggtccccctgggcctcctggccccacaggtgtccctgggagtcctggtcacataggacccccaggccccactggacccaaaggaatctctggccacccaggagagaagggcgagagaggactgcgtggggagcctggcccccaaggctctgctgggcagcggggggaacctggccctaagggagaccctggtgagaagagccactgggctcctagcttacagagcttcctgcagcagcaggctcagctggagctcctggccagacgggtcaccctcctggaagccatcatctggccagaaccagagctggggtctggggcgggccctgccggcacaggcacccccagcctccttcggggcaagaggggcggacatgcaaccaactaccggatcgtggcccccaggagccgggacgagagaggctgagggtggtggcggcccctgaggcagaccaggccaggcttcccctcctacctggactcggccagctgcctccagggaccgcccgtccatatttattaatgtcctcagggtcccttctgccatctaggccttaggggtaagcaggtctcagtcctggcaccatgcacatgtctgaggctgagcaagggctgagaggagaggcttgggcctcagtttccctctgtgaagtggggggaggcaggccttcaaggagggatagaggtacaaggcttcgtctcatctgctgtctgagcatccaggcccaaaggcactgagggagtcaggagctggggctcggcacatgcagagatgacagggcagggggcagtcttcctccccctccccgaccaaacctcggggagccctcctgtgcccctccctccttgttgtccagtgctgggttccccaccccgaggtcaggctgcccaatcctctgactggatcaccgggggcttcttgcctcagttcttccctctgagcccccaggccctcccgcatctcaggttggggatggggacatggagaggaaggggccgcctactcctgcaaatgcttgtgacagatgccaggaggtagatgtgtgctggccaataaaggcccctacctgattccccgca

SEQ ID NO: 319402 - DNA, 831 bp, Homo sapiens
cgccctccggccgcggagctggaaaccgggctccgcgcgtccggggcggctggcggcgcgggcaggcaggcggggaggacaggctgggggcggcgaccgcgaggggccgcgcgcggagggcgcctggtgcagcatgggcggcccgcgggcttgggcgctgctctgcctcgggctcctgctcccgggaggcggcgctgcgtggagcatcggggcagctccgttctccggacgcaggaactggtgctcctatgtggtgacccgcaccatctcatgccatgtgcagaatggcacctaccttcagcgagtgctgcagaactgcccctggcccatgagctgtccggggagcagctacagaactgtggtgagacccacatacaaggtgatgtacaagatagtgaccgcccgtgagtggaggtgctgccctgggcactcaggagtgagctgcgaggaagttgcaggttcctctgcctccttggagcccatgtggtcgggcagtaccatgcggcggatggcgcttcggcccacagccttctcaggttgtctcaactgcagcaaagtgtcagagctgacagagcggctgaaggtgctggaggccaagatgaccatgctgactgtcatagagcagccagtacctccaacaccagctacccctgaggaccctgccccgctctggggtccccctcctgcccagggcagccccggagatggaggcctccaggaccaagtcggtgcttgggggcttcccgggcccaccggccccaagggagatgccggcagtcggggcccaatggggatgagaggcccaccaggtgagtgcccgcaatgctgccc

SEQ ID NO: 319403 - DNA, 467 bp, Homo sapiens
aaaaagaatgtgaagtaaataagcatataggtggccaagagatatagtcatgcaggtgttgggagagcaactggtgctgggcgacagacattagaggacaggagggctcccagcagcttctgggactgccgttctgcccctgaagattggctccccctgccttcagcgcagcaggatttgcggccttgtcagagagcagccagctgggatccaacgggaccttctgggaggtcctgcaggggttgcttccttccgtctgccttgttgtccccctcctgtcctcacctggtcttgttctggctgtccatggaccctgggctgtggcaggtagtgtggggctgcaggtgcatgtcccgggtggggcatgggccaccgacgggctttgcagggtcccctcccctgcccccttcacggctgcatctgtctctttcctccacagggggaggggttgcaccagctacgcgagg

SEQ ID NO: 319404 - DNA, 150 bp, Homo sapiens
gaactggtgctcctatgtggtgacccgcaccatctcatgccatgtgcagaatggcacctaccttcagcgagtgctgcagaactgcccctggcccatgagctgtccggggagcaggtaaatgaggtggagaaggaactgatggcattccag

SEQ ID NO: 319405 - DNA, 2124 bp, Homo sapiens
cgccctccggccgcggagctggaaaccgggctccgcgcgtccggggcggctggcggcgcgggcaggcaggcggggaggacaggctgggggcggcgaccgcgaggggccgcgcgcggagggcgcctggtgcagcatgggcggcccgcgggcttgggcgctgctctgcctcgggctcctgctcccgggaggcggcgctgcgtggagcatcggggcagctccgttctccggacgcaggaactggtgctcctatgtggtgacccgcaccatctcatgccatgtgcagaatggcacctaccttcagcgagtgctgcagaactgcccctggcccatgagctgtccggggagcagctacagaactgtggtgagacccacatacaaggtgatgtacaagatagtgaccgcccgtgagtggaggtgctgccctgggcactcaggagtgagctgcgaggaagttgcaggttcctctgcctccttggagcccatgtggtcgggcagtaccatgcggcggatggcgcttcggcccacagccttctcaggttgtctcaactgcagcaaagtgtcagagctgacagagcggctgaaggtgctggaggccaagatgaccatgctgactgtcatagagcagccagtacctccaacaccagctacccctgaggaccctgccccgctctggggtccccctcctgcccagggcagccccggagatggaggcctccaggaccaagtcggtgcttgggggcttcccgggcccaccggccccaagggagatgccggcagtcggggcccaatggggatgagaggcccaccaggtccacagggccccccagggagccctggccgggctggagctgtgggcacccctggagagaggggacctcctgggccaccagggcctcctggcccccctgggcccccagcccctgttgggccaccccatgcccggatctcccagcatggagacccattgctgtccaacaccttcactgagaccaacaaccactggccccagggacccactgggcctccaggccctccagggcccatgggtccccctgggcctcctggccccacaggtgtccctgggagtcctggtcacataggacccccaggccccactggacccaaaggaatctctggccacccaggagagaagggcgagagaggactgcgtggggagcctggcccccaaggctctgctgggcagcggggggaacctggccctaagggagaccctggtgagaagagccactgggctcctagcttacagagcttcctgcagcagcaggctcagctggagctcctggccagacgggtcaccctcctggaagccatcatctggccagaaccagagctggggtctggggcgggccctgccggcacaggcacccccagcctccttcggggcaagaggggcggacatgcaaccaactaccggatcgtggcccccaggagccgggacgagagaggctgagggtggtggcggcccctgaggcagaccaggccaggcttcccctcctacctggactcggccagctgcctccagggaccgcccgtccatatttattaatgtcctcagggtcccttctgccatctaggccttaggggtaagcaggtctcagtcctggcaccatgcacatgtctgaggctgagcaagggctgagaggagaggcttgggcctcagtttccctctgtgaagtggggggaggcaggccttcaaggagggatagaggtacaaggcttcgtctcatctgctgtctgagcatccaggcccaaaggcactgagggagtcaggagctggggctcggcacatgcagagatgacagggcagggggcagtcttcctccccctccccgaccaaacctcggggagccctcctgtgcccctccctccttgttgtccagtgctgggttccccaccccgaggtcaggctgcccaatcctctgactggatcaccgggggcttcttgcctcagttcttccctctgagcccccaggccctcccgcatctcaggttggggatggggacatggagaggaaggggccgcctactcctgcaaatgcttgtgacagatgccaggaggtagatgtgtgctggccaataaaggcccctacctgattccccgca

SEQ ID NO: 319406 - DNA, 2192 bp, Homo sapiens
cgccctccggccgcggagctggaaaccgggctccgcgcgtccggggcggctggcggcgcgggcaggcaggcggggaggacaggctgggggcggcgaccgcgaggggccgcgcgcggagggcgcctggtgcagcatgggcggcccgcgggcttgggcgctgctctgcctcgggctcctgctcccgggaggcggcgctgcgtggagcatcggggcagctccgttctccggacgcaggaactggtgctcctatgtggtgacccgcaccatctcatgccatgtgcagaatggcacctaccttcagcgagtgctgcagaactgcccctggcccatgagctgtccggggagcagctacagaactgtggtgagacccacatacaaggtgatgtacaagatagtgaccgcccgtgagtggaggtgctgccctgggcactcaggagtgagctgcgaggaagttgcaggttcctctgcctccttggagcccatgtggtcgggcagtaccatgcggcggatggcgcttcggcccacagccttctcagagactgaagggttctgaggggaagcctaggacccttggccctggccccagcttcctccctccccgcaggttgtctcaactgcagcaaagtgtcagagctgacagagcggctgaaggtgctggaggccaagatgaccatgctgactgtcatagagcagccagtacctccaacaccagctacccctgaggaccctgccccgctctggggtccccctcctgcccagggcagccccggagatggaggcctccaggaccaagtcggtgcttgggggcttcccgggcccaccggccccaagggagatgccggcagtcggggcccaatggggatgagaggcccaccaggtccacagggccccccagggagccctggccgggctggagctgtgggcacccctggagagaggggacctcctgggccaccagggcctcctggcccccctgggcccccagcccctgttgggccaccccatgcccggatctcccagcatggagacccattgctgtccaacaccttcactgagaccaacaaccactggccccagggacccactgggcctccaggccctccagggcccatgggtccccctgggcctcctggccccacaggtgtccctgggagtcctggtcacataggacccccaggccccactggacccaaaggaatctctggccacccaggagagaagggcgagagaggactgcgtggggagcctggcccccaaggctctgctgggcagcggggggaacctggccctaagggagaccctggtgagaagagccactgggctcctagcttacagagcttcctgcagcagcaggctcagctggagctcctggccagacgggtcaccctcctggaagccatcatctggccagaaccagagctggggtctggggcgggccctgccggcacaggcacccccagcctccttcggggcaagaggggcggacatgcaaccaactaccggatcgtggcccccaggagccgggacgagagaggctgagggtggtggcggcccctgaggcagaccaggccaggcttcccctcctacctggactcggccagctgcctccagggaccgcccgtccatatttattaatgtcctcagggtcccttctgccatctaggccttaggggtaagcaggtctcagtcctggcaccatgcacatgtctgaggctgagcaagggctgagaggagaggcttgggcctcagtttccctctgtgaagtggggggaggcaggccttcaaggagggatagaggtacaaggcttcgtctcatctgctgtctgagcatccaggcccaaaggcactgagggagtcaggagctggggctcggcacatgcagagatgacagggcagggggcagtcttcctccccctccccgaccaaacctcggggagccctcctgtgcccctccctccttgttgtccagtgctgggttccccaccccgaggtcaggctgcccaatcctctgactggatcaccgggggcttcttgcctcagttcttccctctgagcccccaggccctcccgcatctcaggttggggatggggacatggagaggaaggggccgcctactcctgcaaatgcttgtgacagatgccaggaggtagatgtgtgctggccaataaaggcccctacctgattccccgca

SEQ ID NO: 319407 - DNA, 1760 bp, Homo sapiens
cgccctccggccgcggagctggaaaccgggctccgcgcgtccggggcggctggcggcgcgggcaggcaggcggggaggacaggctgggggcggcgaccgcgaggggccgcgcgcggagggcgcctggtgcagcatgggcggcccgcgggcttgggcgctgctctgcctcgggctcctgctcccgggaggcggcgctgcgtggagcatcggggcagctccgttctccggacgcagatgaccatgctgactgtcatagagcagccagtacctccaacaccagctacccctgaggaccctgccccgctctggggtccccctcctgcccagggcagccccggagatggaggcctccaggaccaagtcggtgcttgggggcttcccgggcccaccggccccaagggagatgccggcagtcggggcccaatggggatgagaggcccaccaggtccacagggccccccagggagccctggccgggctggagctgtgggcacccctggagagaggggacctcctgggccaccagggcctcctggcccccctgggcccccagcccctgttgggccaccccatgcccggatctcccagcatggagacccattgctgtccaacaccttcactgagaccaacaaccactggccccagggacccactgggcctccaggccctccagggcccatgggtccccctgggcctcctggccccacaggtgtccctgggagtcctggtcacataggacccccaggccccactggacccaaaggaatctctggccacccaggagagaagggcgagagaggactgcgtggggagcctggcccccaaggctctgctgggcagcggggggaacctggccctaagggagaccctggtgagaagagccactgggctcctagcttacagagcttcctgcagcagcaggctcagctggagctcctggccagacgggtcaccctcctggaagccatcatctggccagaaccagagctggggtctggggcgggccctgccggcacaggcacccccagcctccttcggggcaagaggggcggacatgcaaccaactaccggatcgtggcccccaggagccgggacgagagaggctgagggtggtggcggcccctgaggcagaccaggccaggcttcccctcctacctggactcggccagctgcctccagggaccgcccgtccatatttattaatgtcctcagggtcccttctgccatctaggccttaggggtaagcaggtctcagtcctggcaccatgcacatgtctgaggctgagcaagggctgagaggagaggcttgggcctcagtttccctctgtgaagtggggggaggcaggccttcaaggagggatagaggtacaaggcttcgtctcatctgctgtctgagcatccaggcccaaaggcactgagggagtcaggagctggggctcggcacatgcagagatgacagggcagggggcagtcttcctccccctccccgaccaaacctcggggagccctcctgtgcccctccctccttgttgtccagtgctgggttccccaccccgaggtcaggctgcccaatcctctgactggatcaccgggggcttcttgcctcagttcttccctctgagcccccaggccctcccgcatctcaggttggggatggggacatggagaggaaggggccgcctactcctgcaaatgcttgtgacagatgccaggaggtagatgtgtgctggccaataaaggcccctacctgattccccgca

SEQ ID NO: 319408 - DNA, 4718 bp, Homo sapiens
tcagcgacgctgcgcgggtggcggtttgcgaactgcgggtggactgtgtagtgaccggcgtcccgctgtctcgccccgtggcgggtgagcgagggtgcgtggtgcgcggcggcggcggaacgaacgcggtgcgggcggggcgcccgccgcagggcccatggcctcctgcgcgagcatcgacatcgaggacgccacgcagcacctgcgggacatcctcaagctggaccggcccgcgggcggccccagtgcagagagcccacggccatccagtgcctacaatggggacctcaatggacttctggtcccagacccgctctgctcaggtgatagtacctcagcaaacaagactggtcttcggaccatgccacccattaacctgcaagagaagcaggtcatctgtctctcaggagatgatagctccacctgcattgggattttggccaaggaggtggagattgtggctagcagtgactctagcatttcaagcaaggcccggggaagcaacaaggtgaaaattcagcctgtcgccaagtatgactgggaacagaagtactactatggcaacctgattgctgtgtctaactccttcttggcctatgccattcgggctgccaacaatggctctgccatggtgcgggtgatcagcgtcagcacttcggagcggaccttgctcaagggcttcacaggcagtgtggctgatctggctttcgcgcacctcaactctccacagctggcctgcctggatgaggcaggcaacctgttcgtgtggcgcttggctctggttaatggcaaaattcaagaagagatcttggtccatattcggcagccagagggcacgccactgaaccactttcgcaggatcatctggtgccccttcatccctgaggagagcgaagactgctgtgaggagagcagcccaacagtggccctgctgcatgaagaccgggctgaggtgtgggacctggacatgctccgctccagccacagtacctggcctgtggatgttagccagatcaagcagggcttcattgtggtaaaaggtcatagcacgtgcctcagtgaaggagccctctctcctgatgggactgtgctggctactgcgagccacgatggctatgtcaagttctggcagatctacattgaggggcaagatgagccaaggtgtctgcacgagtggaaacctcatgatgggcggcccctctcctgcctcctgttctgtgacaaccataagaaacaagaccctgatgtccctttctggaggttccttattactggtgctgaccagaaccgagagttaaagatgtggtgtacagtatcctggacctgcctgcagactattcgcttctccccagatatcttcagctcagtgagtgtgccccctagcctcaaggtttgcttggacctctcagcagaatacctgattctcagcgatgtgcaacggaaggtcctctatgtgatggagctgctgcaaaaccaggaggagggccacgcctgcttcagctccatctcggagttcctgctcacccaccctgtgctgagctttggtatccaggttgtgagtcgctgccggctacggcacactgaggtgctgcctgccgaagaggaaaatgacagcctgggtgctgatggtacccatggagccggtgccatggagtctgcggccggtgtgctcatcaagctcttttgtgtgcatactaaggcactgcaagatgtgcagatccgcttccagccacagctgaaccctgatgtggtggccccactgcccacccacactgcccacgaggacttcacatttggagagtctcggcccgaactgggctctgagggcctggggtcagccgctcacggctcccagcctgacctccgacgaatcgtggagctgcctgcacctgccgacttcctcagtctgagcagtgagaccaagcccaagttgatgacacctgacgccttcatgacacctagcgcctccttgcagcagatcactgcctctcccagcagcagcagcagcggtagcagcagcagcagcagcagtagcagcagctcccttacagctgtgtctgccatgagcagcacctcagctgtggacccctccttgaccaggccacctgaggagctgaccttgagccccaagctgcagctggatggcagcctgacaatgagcagcagtggcagccttcaggcaagcccgcgtggcctcctgcctggcctgctcccagccccagctgacaaactgactcccaaggggccgggccaggtgcctactgccacctctgcactgtccctggagctgcaggaagtggagcccctggggctaccccaagcctcccctagccgcactcgttcccctgatgtcatctcctcagcttccactgccctgtcccaggacatccctgagattgcatctgaggccctgtcccgtggttttggctcctctgcaccagagggccttgagccagacagtatggcttcagccgcctcggcactgcacctgctgtccccacggccccggccagggcccgagctcggcccccagctcgggcttgatggaggccctggggatggagatcggcataataccccctccctcctggaggcagccttgacccaggaggcctcgactcctgacagtcaggtttggcccacagcacctgacattactcgtgagacctgcagcaccctggcagaaagccccaggaatggccttcaggaaaagcacaagagcctggccttccaccgaccaccatatcacctgctgcagcaacgtgacagccaggatgccagtgctgagcaaagtgaccatgatgatgaggtggccagccttgcctctgcttcaggaggctttggcaccaaagttcctgctccacggctgcctgccaaggactggaagaccaagggatcccctcgaacctcacccaagctcaagaggaaaagcaagaaggatgatggggatgcagccatgggatcccggctcacagagcaccaggtggcagagccccctgaggactggccagcactaatttggcaacagcagagagagctggcagagctgcggcacagccaggaagagctgctgcagcgtctgtgtacccaactcgaaggcctgcagagcacagtcacaggccacgtagaacgtgcccttgagactcggcacgagcaggaacagcggcggctggagcgagcactggctgaggggcagcagcggggagggcagctgcaggagcagctgacacaacagttgtcccaagcactgtcgtcagctgtagctgggcggctagagcgcagcatacgggatgagatcaagaagacagtccctccatgtgtctcaaggagtctggagcctatggcaggccaactgagcaactcagtggctaccaagctcacagctgtggagggcagcatgaaagagaacatctccaagctgctcaagtccaagaacttgactgatgccatcgcccgagcagctgcagacacattacaagggccgatgcaggctgcctaccgggaagccttccagagtgtggtgctgccggcctttgagaagagctgccaggccatgttccagcaaatcaatgatagcttccggctggggacacaggaatacttgcagcagctagaaagccacatgaagagccggaaggcacgggaacaggaggccagggagcctgtgctagcccagctgcggggcctggtcagcacactgcagagtgccactgagcagatggcagccaccgtggccggcagtgttcgtgctgaggtgcagcaccagctgcatgtggctgtgggcagcctgcaggagtccattttagcacaggtacagcgcatcgttaagggtgaggtgagtgtggcgctcaaggagcagcaggccgccgtcacctccagcatcatgcaggccatgcgctcagctgctggcacacctgtcccctctgcccaccttgactgccaggcccagcaagcccatatcctgcagctgctgcagcagggccacctcaatcaggccttccagcaggcgctgacagctgctgacctgaacctggtgctgtatgtgtgtgaaactgtggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttggaataaaatgga

SEQ ID NO: 319409 - DNA, 336 bp, Homo sapiens
  misc_feature (33)..(33): n is a, c, g, or t
atacacgccatattagcagcctccgtggcctcnagcaggtacgataggcattaggccctgctaagggtcacgtgtctcttgacaaggcccacataccatacattctactccacccaccacctttgcaccttctggccccagcagactgttcttggttccctttggcctccaggccattgtccctgctgcttcctcttcctggacccctttcttcccacctagcccaccttgctttacaactacccttctcaggaacccatttcccaatcccctagggtaactacacagccctacaggctctctctgagtccctctggagctctcactagcccaccc

SEQ ID NO: 319410 - DNA, 4824 bp, Homo sapiens
tcagcgacgctgcgcgggtggcggtttgcgaactgcgggtggactgtgtagtgaccggcgtcccgctgtctcgccccgtggcgggtgagcgagggtgcgtggtgcgcggcggcggcggaacgaacgcggtgcgggcggggcgcccgccgcagggcccatggcctcctgcgcgagcatcgacatcgaggacgccacgcagcacctgcgggacatcctcaagctggaccggcccgcgggcggccccagtgcagagagcccacggccatccagtgcctacaatggggacctcaatggacttctggtcccagacccgctctgctcaggtgatagtacctcagcaaacaagactggtcttcggaccatgccacccattaacctgcaagagaagcaggtcatctgtctctcaggagatgatagctccacctgcattgggattttggccaaggaggtggagattgtggctagcagtgactctagcatttcaagcaaggcccggggaagcaacaaggtgaaaattcagcctgtcgccaagtatgactgggaacagaagtactactatggcaacctgattgctgtgtctaactccttcttggcctatgccattcgggctgccaacaatggctctgccatggtgcgggtgatcagcgtcagcacttcggagcggaccttgctcaagggcttcacaggcagtgtggctgatctggctttcgcgcacctcaactctccacagctggcctgcctggatgaggcaggcaacctgttcgtgtggcgcttggctctggttaatggcaaaattcaagaagagatcttggtccatattcggcagccagagggcacgccactgaaccactttcgcaggatcatctggtgccccttcatccctgaggagagcgaagactgctgtgaggagagcagcccaacagtggccctgctgcatgaagaccgggctgaggtgtgggacctggacatgctccgctccagccacagtacctggcctgtggatgttagccagatcaagcagggcttcattgtggtaaaaggtcatagcacgtgcctcagtgaaggagccctctctcctgatgggactgtgctggctactgcgagccacgatggctatgtcaagttctggcagatctacattgaggggcaagatgagccaaggtgtctgcacgagtggaaacctcatgatgggcggcccctctcctgcctcctgttctgtgacaaccataagaaacaagaccctgatgtccctttctggaggttccttattactggtgctgaccagaaccgagagttaaagatgtggtgtacagtatcctggacctgcctgcagactattcgcttctccccagatatcttcagctcagtgagtgtgccccctagcctcaaggtttgcttggacctctcagcagaatacctgattctcagcgatgtgcaacggaaggtcctctatgtgatggagctgctgcaaaaccaggaggagggccacgcctgcttcagctccatctcggagttcctgctcacccaccctgtgctgagctttggtatccaggttgtgagtcgctgccggctacggcacactgaggtgctgcctgccgaagaggaaaatgacagcctgggtgctgatggtacccatggagccggtgccatggagtctgcggccggtgtgctcatcaagctcttttgtgtgcatactaaggcactgcaagatgtgcagatccgcttccagccacagctgaaccctgatgtggtggccccactgcccacccacactgcccacgaggacttcacatttggagagtctcggcccgaactgggctctgagggcctggggtcagccgctcacggctcccagcctgacctccgacgaatcgtggagctgcctgcacctgccgacttcctcagtctgagcagtgagaccaagcccaagttgatgacacctgacgccttcatgacacctagcgcctccttgcagcagatcactgcctctcccagcagcagcagcagcggtagcagcagcagcagcagcagtagcagcagctcccttacagctgtgtctgccatgagcagcacctcagctgtggacccctccttgaccaggccacctgaggagctgaccttgagccccaagctgcagctggatggcagcctgacaatgagcagcagtggcagccttcaggcaagcccgcgtggcctcctgcctggcctgctcccagccccagctgacaaactgactcccaaggggccgggccaggtgcctactgccacctctgcactgtccctggagctgcaggaagtggagcccctggggctaccccaagcctcccctagccgcactcgttcccctgatgtcatctcctcagcttccactgccctgtcccaggacatccctgagattgcatctgaggccctgtcccgtggttttggctcctctgcaccagagggccttgagccagacagtatggcttcagccgcctcggcactgcacctgctgtccccacggccccggccagggcccgagctcggcccccagctcgggcttgatggaggccctggggatggagatcggcataataccccctccctcctggaggcagccttgacccaggaggcctcgactcctgacagtcaggtttggcccacagcacctgacattactcgtgagacctgcagcaccctggcagaaagccccaggaatggccttcaggaaaagcacaagagcctggccttccaccgaccaccatatcacctgctgcagcaacgtgacagccaggatgccagtgctgagcaaagtgaccatgatgatgaggtggccagccttgcctctgcttcaggaggctttggcaccaaagttcctgctccacggctgcctgccaaggactggaagaccaagggatcccctcgaacctcacccaagctcaagaggaaaagcaagaaggatgatggggatgcagccatgggatcccggctcacagagcaccaggtggcagagccccctgaggactggccagcactaatttggcaacagcagagagagctggcagagctgcggcacagccaggaagagctgctgcagcgtctgtgtacccaactcgaaggcctgcagagcacagtcacaggccacgtagaacgtgcccttgagactcggcacgagcaggaacatccttgagactggtagcacaacatggcatagggacgggggcagcattcttggcctgggaaggagtacacgacctgctccaggcccgttccttagctatggcgcagagcggcggctggagcgagcactggctgaggggcagcagcggggagggcagctgcaggagcagctgacacaacagttgtcccaagcactgtcgtcagctgtagctgggcggctagagcgcagcatacgggatgagatcaagaagacagtccctccatgtgtctcaaggagtctggagcctatggcaggccaactgagcaactcagtggctaccaagctcacagctgtggagggcagcatgaaagagaacatctccaagctgctcaagtccaagaacttgactgatgccatcgcccgagcagctgcagacacattacaagggccgatgcaggctgcctaccgggaagccttccagagtgtggtgctgccggcctttgagaagagctgccaggccatgttccagcaaatcaatgatagcttccggctggggacacaggaatacttgcagcagctagaaagccacatgaagagccggaaggcacgggaacaggaggccagggagcctgtgctagcccagctgcggggcctggtcagcacactgcagagtgccactgagcagatggcagccaccgtggccggcagtgttcgtgctgaggtgcagcaccagctgcatgtggctgtgggcagcctgcaggagtccattttagcacaggtacagcgcatcgttaagggtgaggtgagtgtggcgctcaaggagcagcaggccgccgtcacctccagcatcatgcaggccatgcgctcagctgctggcacacctgtcccctctgcccaccttgactgccaggcccagcaagcccatatcctgcagctgctgcagcagggccacctcaatcaggccttccagcaggcgctgacagctgctgacctgaacctggtgctgtatgtgtgtgaaactgtggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttggaataaaatgga

SEQ ID NO: 319411 - DNA, 4607 bp, Homo sapiens
tcagcgacgctgcgcgggtggcggtttgcgaactgcgggtggactgtgtagtgaccggcgtcccgctgtctcgccccgtggcgggtgagcgagggtgcgtggtgcgcggcggcggcggaacgaacgcggtgcgggcggggcgcccgccgcagggcccatggcctcctgcgcgagcatcgacatcgaggacgccacgcagcacctgcgggacatcctcaagctggaccggcccgcgggcggccccagtgcagagagcccacggccatccagtgcctacaatggggacctcaatggacttctggtcccagacccgctctgctcaggtgatagtacctcagcaaacaagactggtcttcggaccatgccacccattaacctgcaagagaagcaggtcatctgtctctcaggagatgatagctccacctgcattgggattttggccaaggaggtggagattgtggctagcagtgactctagcatttcaagcaaggcccggggaagcaacaaggtgaaaattcagcctgtcgccaagtatgactgggaacagaagtactactatggcaacctgattgctgtgtctaactccttcttggcctatgccattcgggctgccaacaatggctctgccatggtgcgggtgatcagcgtcagcacttcggagcggaccttgctcaagggcttcacaggcagtgtggctgatctggctttcgcgcacctcaactctccacagctggcctgcctggatgaggcaggcaacctgttcgtgtggcgcttggctctggttaatggcaaaattcaagaagagatcttggtccatattcggcagccagagggcacgccactgaaccactttcgcaggatcatctggtgccccttcatccctgaggagagcgaagactgctgtgaggagagcagcccaacagtggccctgctgcatgaagaccgggctgaggtgtgggacctggacatgctccgctccagccacagtacctggcctgtggatgttagccagatcaagcagggcttcattgtggtaaaaggtcatagcacgtgcctcagtgaaggagccctctctcctgatgggactgtgctggctactgcgagccacgatggctatgtcaagttctggcagatctacattgaggggcaagatgagccaaggtgtctgcacgagtggaaacctcatgatgggcggcccctctcctgcctcctgttctgtgacaaccataagaaacaagaccctgatgtccctttctggaggttccttattactggtgctgaccagaaccgagagttaaagatgtggtgtacagtatcctggacctgcctgcagactattcgcttctccccagatatcttcagctcagtgagtgtgccccctagcctcaaggtttgcttggacctctcagcagaatacctgattctcagcgatgtgcaacggaaggtcctctatgtgatggagctgctgcaaaaccaggaggagggccacgcctgcttcagctccatctcggagttcctgctcacccaccctgtgctgagctttggtatccaggttgtgagtcgctgccggctacggcacactgaggtgctgcctgccgaagaggaaaatgacagcctgggtgctgatggtacccatggagccggtgccatggagtctgcggccggtgtgctcatcaagctcttttgtgtgcatactaaggcactgcaagatgtgcagatccgcttccagccacagctgaaccctgatgtggtggccccactgcccacccacactgcccacgaggacttcacatttggagagtctcggcccgaactgggctctgagggcctggggtcagccgctcacggctcccagcctgacctccgacgaatcgtggagctgcctgcacctgccgacttcctcagtctgagcagtgagaccaagcccaagttgatgacacctgacgccttcatgacacctagcgcctccttgcagcagatcactgcctctcccagcagcagcagcagcggtagcagcagcagcagcagcagtagcagcagctcccttacagctgtgtctgccatgagcagcacctcagctgtggacccctccttgaccaggccacctgaggagctgaccttgagccccaagctgcagctggatggcagcctgacaatgagcagcagtggcagccttcaggcaagcccgcgtggcctcctgcctggcctgctcccagccccagctgacaaactgactcccaaggggccgggccaggtgcctactgccacctctgcactgtccctggagctgcaggaagtggagcccctggggctaccccaagcctcccctagccgcactcgttcccctgatgtcatctcctcagcttccactgccctgtcccaggacatccctgagattgcatctgaggccctgtcccgtggttttggctcctctgcaccagagggccttgagccagacagtatggcttcagccgcctcggcactgcacctgctgtccccacggccccggccagggcccgagctcggcccccagctcgggcttgatggaggccctggggatggagatcggcataataccccctccctcctggaggcagccttgacccaggaggcctcgactcctgacagtcaggtttggcccacagcacctgacattactcgtgagacctgcagcaccctggcagaaagccccaggaatggccttcaggaaaagcacaagagcctggccttccaccgaccaccatatcacctgctgcagcaacgtgacagccaggatgccagtgctgagcaaagtgaccatgatgatgaggtggccagccttgcctctgcttcaggaggctttggcaccaaagttcctgctccacggctgcctgccaaggactggaagaccaagggatcccctcgaacctcacccaagctcaagaggaaaagcaagaaggatgatggggatgcagccatgggatcccggctcacagagcaccaggtggcagagccccctgaggactggccagcactaatttggcaacagcagagagagctggcagagctgcggcacagccaggaagagctgctgcagcgtctgtgtacccaactcgaaggcctgcagagcacagtcacaggccacgtagaacgtgcccttgagactcggcacgagcaggaacagcggcggctggagcgagcactggctgaggggcagcagcggggagggcagctgcaggagcagctgacacaacagttgtcccaagcactgtcgtcagctgtagctgggcggctagagcgcagcatacgggatgagatcaagaagacagtccctccatgtgtctcaaggagtctggagcctatggcaggccaactgagcaactcagtggctaccaagctcacagctgtggagggcagcatgaaagagaacatctccaagctgctcaagtccaagaacttgactgatgccatcgcccgagcagctgcagacacattacaagggccgatgcaggctgcctaccgggaagccttccagagtgtggtgctgccggcctttgagaagagctgccaggccatgttccagcaaatcaatgatagcttccggctggggacacaggaatacttgcagcagctagaaagccacatgaagagccggaaggcacgggaacaggaggccagggagcctgtgctagcccagctgcggggcctggtcagcacactgcagagtgccactgagcagatggcagccaccgtggccggcagtgttcgtgctgaggtgcagcaccagctgcatgtggctgtgggcagcctgcaggagtccattttagcacaggtacagcgcatcgttaagggtgagcagcaagcccatatcctgcagctgctgcagcagggccacctcaatcaggccttccagcaggcgctgacagctgctgacctgaacctggtgctgtatgtgtgtgaaactgtggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttggaataaaatgga

SEQ ID NO: 319412 - DNA, 4562 bp, Homo sapiens
tcagcgacgctgcgcgggtggcggtttgcgaactgcgggtggactgtgtagtgaccggcgtcccgctgtctcgccccgtggcgggtgagcgagggtgcgtggtgcgcggcggcggcggaacgaacgcggtgcgggcggggcgcccgccgcagggcccatggcctcctgcgcgagcatcgacatcgaggacgccacgcagcacctgcgggacatcctcaagctggaccggcccgcgggcggccccagtgcagagagcccacggccatccagtgcctacaatggggacctcaatggacttctggtcccagacccgctctgctcaggtgatagtacctcagcaaacaagactggtcttcggaccatgccacccattaacctgcaagagaagcaggtcatctgtctctcaggagatgatagctccacctgcattgggattttggccaaggaggtggagattgtggctagcagtgactctagcatttcaagcaaggcccggggaagcaacaaggtgaaaattcagcctgtcgccaagtatgactgggaacagaagtactactatggcaacctgattgctgtgtctaactccttcttggcctatgccattcgggctgccaacaatggctctgccatggtgcgggtgatcagcgtcagcacttcggagcggaccttgctcaagggcttcacaggcagtgtggctgatctggctttcgcgcacctcaactctccacagctggcctgcctggatgaggcaggcaacctgttcgtgtggcgcttggctctggttaatggcaaaattcaagaagagatcttggtccatattcggcagccagagggcacgccactgaaccactttcgcaggatcatctggtgccccttcatccctgaggagagcgaagactgctgtgaggagagcagcccaacagtggccctgctgcatgaagaccgggctgaggtgtgggacctggacatgctccgctccagccacagtacctggcctgtggatgttagccagatcaagcagggcttcattgtggtaaaaggtcatagcacgtgcctcagtgaaggagccctctctcctgatgggactgtgctggctactgcgagccacgatggctatgtcaagttctggcagatctacattgaggggcaagatgagccaaggtgtctgcacgagtggaaacctcatgatgggcggcccctctcctgcctcctgttctgtgacaaccataagaaacaagaccctgatgtccctttctggaggttccttattactggtgctgaccagaaccgagagttaaagatgtggtgtacagtatcctggacctgcctgcagactattcgcttctccccagatatcttcagctcagtgagtgtgccccctagcctcaaggtttgcttggacctctcagcagaatacctgattctcagcgatgtgcaacggaaggtcctctatgtgatggagctgctgcaaaaccaggaggagggccacgcctgcttcagctccatctcggagttcctgctcacccaccctgtgctgagctttggtatccaggttgtgagtcgctgccggctacggcacactgaggtgctgcctgccgaagaggaaaatgacagcctgggtgctgatggtacccatggagccggtgccatggagtctgcggccggtgtgctcatcaagctcttttgtgtgcatactaaggcactgcaagatgtgcagatccgcttccagccacagctgaaccctgatgtggtggccccactgcccacccacactgcccacgaggacttcacatttggagagtctcggcccgaactgggctctgagggcctggggtcagccgctcacggctcccagcctgacctccgacgaatcgtggagctgcctgcacctgccgacttcctcagtctgagcagtgagaccaagcccaagttgatgacacctgacgccttcatgacacctagcgcctccttgcagcagatcactgcctctcccagcagcagcagcagcggtagcagcagcagcagcagcagtagcagcagctcccttacagctgtgtctgccatgagcagcacctcagctgtggacccctccttgaccaggccacctgaggagctgaccttgagccccaagctgcagctggatggcagcctgacaatgagcagcagtggcagccttcaggcaagcccgcgtggcctcctgcctggcctgctcccagccccagctgacaaactgactcccaaggggccgggccaggtgcctactgccacctctgcactgtccctggagctgcaggaagtggagcccctggggctaccccaagcctcccctagccgcactcgttcccctgatgtcatctcctcagcttccactgccctgtcccaggacatccctgagattgcatctgaggccctgtcccgtggttttggctcctctgcaccagagggccttgagccagacagtatggcttcagccgcctcggcactgcacctgctgtccccacggccccggccagggcccgagctcggcccccagctcgggcttgatggaggccctggggatggagatcggcataataccccctccctcctggaggcagccttgacccaggaggcctcgactcctgacagtcaggtttggcccacagcacctgacattactcgtgagacctgcagcaccctggcagaaagccccaggaatggccttcaggaaaagcacaagagcctggccttccaccgaccaccatatcacctgctgcagcaacgtgacagccaggatgccagtgctgagcaaagtgaccatgatgatgaggtggccagccttgcctctgcttcaggaggctttggcaccaaagttcctgctccacggctgcctgccaaggactggaagaccaagggatcccctcgaacctcacccaagctcaagaggaaaagcaagaaggatgatggggatgcagccatgggatcccggctcacagagcaccaggtggcagagccccctgaggactggccagcactaatttggcaacagcagagagagctggcagagctgcggcacagccaggaagagctgctgcagcgtctgtgtacccaactcgaaggcctgcagagcacagtcacaggccacgtagaacgtgcccttgagactcggcacgagcaggaacgtgtctcaaggagtctggagcctatggcaggccaactgagcaactcagtggctaccaagctcacagctgtggagggcagcatgaaagagaacatctccaagctgctcaagtccaagaacttgactgatgccatcgcccgagcagctgcagacacattacaagggccgatgcaggctgcctaccgggaagccttccagagtgtggtgctgccggcctttgagaagagctgccaggccatgttccagcaaatcaatgatagcttccggctggggacacaggaatacttgcagcagctagaaagccacatgaagagccggaaggcacgggaacaggaggccagggagcctgtgctagcccagctgcggggcctggtcagcacactgcagagtgccactgagcagatggcagccaccgtggccggcagtgttcgtgctgaggtgcagcaccagctgcatgtggctgtgggcagcctgcaggagtccattttagcacaggtacagcgcatcgttaagggtgaggtgagtgtggcgctcaaggagcagcaggccgccgtcacctccagcatcatgcaggccatgcgctcagctgctggcacacctgtcccctctgcccaccttgactgccaggcccagcaagcccatatcctgcagctgctgcagcagggccacctcaatcaggccttccagcaggcgctgacagctgctgacctgaacctggtgctgtatgtgtgtgaaactgtggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttggaataaaatgga

SEQ ID NO: 319413 - DNA, 1873 bp, Homo sapiens
cgtgattagaggatcccctcagctggccccaaggactggaagaccaagggatcccctcgaacctcacccaagctcaagaggaaaagcaagaaggatgatggggatgcagccatgggatcccggctcacagagcaccaggtggcagagccccctgaggactggccagcactaatttggcaacagcagagagagctggcagagctgcggcacagccaggaagagctgctgcagcgtctgtgtacccaactcgaaggcctgcagagcacagtcacaggccacgtagaacgtgcccttgagactcggcacgagcaggaacagcggcggctggagcgagcactggctgaggggcagcagcggggagggcagctgcaggagcagctgacacaacagttgtcccaagcactgtcgtcagctgtagctgggcggctagagcgcagcatacgggatgagatcaagaagacagtccctccatgtgtctcaaggagtctggagcctatggcaggccaactgagcaactcagtggctaccaagctcacagctgtggagggcagcatgaaagagaacatctccaagctgctcaagtccaagaacttgactgatgccatcgcccgagcagctgcagacacattacaagggccgatgcaggctgcctaccgggaagccttccagagtgtggtgctgccggcctttgagaagagctgccaggccatgttccagcaaatcaatgatagcttccggctggggacacaggaatacttgcagcagctagaaagccacatgaagagccggaaggcacgggaacaggaggccagggagcctgtgctagcccagctgcggggcctggtcagcacactgcagagtgccactgagcagatggcagccaccgtggccggcagtgttcgtgctgaggtgcagcaccagctgcatgtggctgtgggcagcctgcaggagtccattttagcacaggtacagcgcatcgttaagggtgaggtgagtgtggcgctcaaggagcagcaggccgccgtcacctccagcatcatgcaggccatgcgctcagctgctggcacacctgtcccctctgcccaccttgactgccaggcccagcaagcccatatcctgcagctgctgcagcagggccacctcaatcaggccttccagcaggcgctgacagctgctgacctgaacctggtgctgtatgtgtgtgaaactgtggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttggaataaaatgga

SEQ ID NO: 319414 - DNA, 1666 bp, Homo sapiens
tagaggatccgccgctgctccctcttcaaaatgagatcatataatatttggttttccattcctgagttacttcacttagagtaacggtctccaggccaggcacggtggctcacacctgtaatcccagcactttcggaggccaaggcagatggatcacgaggccaggagcagctgacacaacagttgtcccaagcactgtcgtcagctgtagctgggcggctagagcgcagcatacgggatgagatcaagaagacagtccctccatgtgtctcaaggagtctggagcctatggcaggccaactgagcaactcagtggctaccaagctcacagctgtggagggcagcatgaaagagaacatctccaagctgctcaagtccaagaacttgactgatgccatcgcccgagcagctgcagacacattacaagggccgatgcaggctgcctaccgggaagccttccagagtgtggtgctgccggcctttgagaagagctgccaggccatgttccagcaaatcaatgatagcttccggctggggacacaggaatacttgcagcagctagaaagccacatgaagagccggaaggcacgggaacaggaggccagggagcctgtgctagcccagctgcggggcctggtcagcacactgcagagtgccactgagcagatggcagccaccgtggccggcagtgttcgtgctgaggtgcagcaccagctgcatgtggctgtgggcagcctgcaggagtccattttagcacaggtacagcgcatcgttaagggtgaggtgagtgtggcgctcaaggagcagcaggccgccgtcacctccagcatcatgcaggccatgcgctcagctgctggcacacctgtcccctctgcccaccttgactgccaggcccagcaagcccatatcctgcagctgctgcagcagggccacctcaatcaggccttccagcaggcgctgacagctgctgacctgaacctggtgctgtatgtgtgtgaaactgtggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttggaataaaatgga

SEQ ID NO: 319415 - DNA, 946 bp, Homo sapiens
  misc_feature (53)..(54): n is a, c, g, or t
gctgacctgaacctggtgctgtatgtgtgtgaaactgtggacccagcccaggnntttgggcagccaccctgcccgctctcccagcctgtgctcctttccctctccagcatcatgcaggccatgcgctcagctgctggcacacctgtcccctctgcccaccttgactgccaggcccagcaagcccatatcctgcagctgctgcagcagggccacctcaatcaggccttccagcaggcgctgacagctgctgacctgaacctggtgctgtatgtgtgtgaaactgtggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttggaataaaatgga

SEQ ID NO: 319416 - DNA, 957 bp, Homo sapiens
  misc_feature (22)..(22): n is a, c, g, or t
ggttccctctgggcctcggtgncaccaggggcgctcccgtctgctggcacccacctgtagcctgtcctttcccccccatcccaggtttttgggcagccaccctgcccgctctcccagcctgtgctcctttccctcatccagcagctggcatctgaccttggcactcgaactgacctcaagctcaggtaagtggggacagccagggatggggagatgagctggggagtggggcagtgggagggagcagtttgaagctgacgcccacttctgcctgaatcctctccctaattttctccaccagtcctttctgccttcacccagagggttccctctgggcctcggtgccaccagggggcgctcccgtctgctggcacccacctgtagcctgtcctttcccccccatccccagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttggaataaaatgga

SEQ ID NO: 319417 - DNA, 3884 bp, Homo sapiens
tcagcgacgctgcgcgggtggcggtttgcgaactgcgggtggactgtgtagtgaccggcgtcccgctgtctcgccccgtggcgggtgagcgagggtgcgtggtgcgcggcggcggcggaacgaacgcggtgcgggcggggcgcccgccgcagggcccatggcctcctgcgcgagcatcgacatcgaggacgccacgcagcacctgcgggacatcctcaagctggaccggcccgcgggcggccccagtgcagagagcccacggccatccagtgcctacaatggggacctcaatggacttctggtcccagacccgctctgctcaggtgatagtacctcagcaaacaagactggtcttcggaccatgccacccattaacctgcaagagaagcaggtcatctgtctctcaggagatgatagctccacctgcattgggattttggccaaggaggtggagattgtggctagcagtgactctagcatttcaagcaaggcccggggaagcaacaaggtgaaaattcagcctgtcgccaagtatgactgggaacagaagtactactatggcaacctgattgctgtgtctaactccttcttggcctatgccattcgggctgccaacaatggctctgccatggtgcgggtgatcagcgtcagcacttcggagcggaccttgctcaagggcttcacaggcagtgtggctgatctggctttcgcgcacctcaactctccacagctggcctgcctggatgaggcaggcaacctgttcgtgtggcgcttggctctggttaatggcaaaattcaagaagagatcttggtccatattcggcagccagagggcacgccactgaaccactttcgcaggatcatctggtgccccttcatccctgaggagagcgaagactgctgtgaggagagcagcccaacagtggccctgctgcatgaagaccgggctgaggtgtgggacctggacatgctccgctccagccacagtacctggcctgtggatgttagccagatcaagcagggcttcattgtggtaaaaggtcatagcacgtgcctcagtgaaggagccctctctcctgatgggactgtgctggctactgcgagccacgatggctatgtcaagttctggcagatctacattgaggggcaagatgagccaaggtgtctgcacgagtggaaacctcatgatgggcggcccctctcctgcctcctgttctgtgacaaccataagaaacaagaccctgatgtccctttctggaggttccttattactggtgctgaccagaaccgagagttaaagatgtggtgtacagtatcctggacctgcctgcagactattcgcttctccccagatatcttcagctcagtgagtgtgccccctagcctcaaggtttgcttggacctctcagcagaatacctgattctcagcgatgtgcaacggaaggtcctctatgtgatggagctgctgcaaaaccaggaggagggccacgcctgcttcagctccatctcggagttcctgctcacccaccctgtgctgagctttggtatccaggttgtgagtcgctgccggctacggcacactgaggtgctgcctgccgaagaggaaaatgacagcctgggtgctgatggtacccatggagccggtgccatggagtctgcggccggtgtgctcatcaagctcttttgtgtgcatactaaggcactgcaagatgtgcagatccgcttccagccacagctgaaccctgatgtggtggccccactgcccacccacactgcccacgaggacttcacatttggagagtctcggcccgaactgggctctgagggcctggggtcagccgctcacggctcccagcctgacctccgacgaatcgtggagctgcctgcacctgccgacttcctcagtctgagcagtgagaccaagcccaagttgatgacacctgacgccttcatgacacctagcgcctccttgcagcagatcactgcctctcccagcagcagcagcagcggtagcagcagcagcagcagcagtagcagcagctcccttacagctgtgtctgccatgagcagcacctcagctgtggacccctccttgaccaggccacctgaggagctgaccttgagccccaagctgcagctggatggcagcctgacaatgagcagcagtggcagccttcaggcaagcccgcgtggcctcctgcctggcctgctcccagccccagctgacaaactgactcccaaggggccgggccaggtgcctactgccacctctgcactgtccctggagctgcaggaagtggagcccctggggctaccccaagcctcccctagccgcactcgttcccctgatgtcatctcctcagcttccactgccctgtcccaggacatccctgagattgcatctgaggccctgtcccgtggttttggctcctctgcaccagagggccttgagccagacagtatggcttcagccgcctcggcactgcacctgctgtccccacggccccggccagggcccgagctcggcccccagctcgggcttgatggaggccctggggatggagatcggcataataccccctccctcctggaggcagccttgacccaggaggcctcgactcctgacagtcaggtttggcccacagcacctgacattactcgtgagacctgcagcaccctggcagaaagccccaggaatggccttcaggaaaagcacaagagcctggccttccaccgaccaccatatcacctgctgcagcaacgtgacagccaggatgccagtgctgagcaaagtgaccatgatgatgaggtggccagccttgcctctgcttcaggaggctttggcaccaaagttcctgctccacggctgcctgccaaggactggaagaccaagggatcccctcgaacctcacccaagctcaagaggaaaagcaagaaggatgatggggatgcagccatgggatcccggctcacagagcaccaggtggcagagccccctgaggactggccagcactaatttggcaacagcagagagagctggcagagctgcggcacagccaggaagagctgctgcagcgtctgtgtacccaactcgaaggcctgcagagcacagtcacaggccacgtagaacgtgcccttgagactcggcacgagcaggaacagcggcggctggagcgagcactggctgaggggcagcagcggggagggcagctgcaggagcagctgacacaacagttgtcccaagcactgtcgtcagctgtagctgggcggctagagcgcagcatacgggatgagatcaagaagacagtccctccatgtgtctcaaggagtctggagcctatggcaggccaactgagcaactcagtggctaccaagctcacagctgtggagggcagcatgaaagagaacatctccaagctgctcaagtccaagaacttgactgatgccatcgcccgagcagctgcagacacattacaagggccgatgcaggctgcctaccgggaagccttccagagtgtggtgctgccggcctttgagaagagctgccaggccatgttccagcaaatcaatgatagcttccggctggggacacaggaatacttgcagcagctagaaagccacatgaagagccggaaggcacgggaacaggaggccagggagcctgtgctagcccagctgcggggcctggtcagcacactgcagagtgccactgagcagatggcagccaccgtggccggcagtgttcgtgctgaggtgcagcaccagctgcatgtggctgtgggcagctgcggagtcatttagcgcggtccgcgatcgtaggtgggggggggtggggcaagggcaggcgcggcctccggttttggggcggccgtgggggccttcc

SEQ ID NO: 319418 - DNA, 385 bp, Homo sapiens
gggagaaatcctagggagggagagggtggtctctaggctgcctcacatagcctgaggtgcttctcgcctatggcagggatgcagccatgggatcccggctcacagagcaccaggtaagtgaatgagcccactttgtacttgtggaacttcaccctgggcgggtggagaagggctctgggccattccctggtctggtgtgtgggaataggtggggcaggcatcgtgtgactgtcagtgctactgacaggtggcagagccccctgaggactggccagcactaatttggcaacagcagagagagctggcagagctgcggcacagccaggaagagctgctgcagcgtctgtgtacccaactcgaaggcctgcagagcacagtcacaggc

SEQ ID NO: 319419 - DNA, 3337 bp, Homo sapiens
aattcctggggaggaaaggattacaaaggagcatccctgattctcagcgatgtgcaacggaaggtcctctatgtgatggagctgctgcaaaaccaggaggagggccacgcctgcttcagctccatctcggagttcctgctcacccaccctgtgctgagctttggtatccaggttgtgagtcgctgccggctacggcacactgaggtgctgcctgccgaagaggaaaatgacagcctgggtgctgatggtacccatggagccggtgccatggagtctgcggccggtgtgctcatcaagctcttttgtgtgcatactaaggcactgcaagatgtgcagatccgcttccagccacagctgaaccctgatgtggtggccccactgcccacccacactgcccacgaggacttcacatttggagagtctcggcccgaactgggctctgagggcctggggtcagccgctcacggctcccagcctgacctccgacgaatcgtggagctgcctgcacctgccgacttcctcagtctgagcagtgagaccaagcccaagttgatgacacctgacgccttcatgacacctagcgcctccttgcagcagatcactgcctctcccagcagcagcagcagcggtagcagcagcagcagcagcagtagcagcagctcccttacagctgtgtctgccatgagcagcacctcagctgtggacccctccttgaccaggccacctgaggagctgaccttgagccccaagctgcagctggatggcagcctgacaatgagcagcagtggcagccttcaggcaagcccgcgtggcctcctgcctggcctgctcccagccccagctgacaaactgactcccaaggggccgggccaggtgcctactgccacctctgcactgtccctggagctgcaggaagtggagcccctggggctaccccaagcctcccctagccgcactcgttcccctgatgtcatctcctcagcttccactgccctgtcccaggacatccctgagattgcatctgaggccctgtcccgtggttttggctcctctgcaccagagggccttgagccagacagtatggcttcagccgcctcggcactgcacctgctgtccccacggccccggccagggcccgagctcggcccccagctcgggcttgatggaggccctggggatggagatcggcataataccccctccctcctggaggcagccttgacccaggaggcctcgactcctgacagtcaggtttggcccacagcacctgacattactcgtgagacctgcagcaccctggcagaaagccccaggaatggccttcaggaaaagcacaagagcctggccttccaccgaccaccatatcacctgctgcagcaacgtgacagccaggatgccagtgctgagcaaagtgaccatgatgatgaggtggccagccttgcctctgcttcaggaggctttggcaccaaagttcctgctccacggctgcctgccaaggactggaagaccaagggatcccctcgaacctcacccaagctcaagaggaaaagcaagaaggatgatggggatgcagccatgggatcccggctcacagagcaccaggtggcagagccccctgaggactggccagcactaatttggcaacagcagagagagctggcagagctgcggcacagccaggaagagctgctgcagcgtctgtgtacccaactcgaaggcctgcagagcacagtcacaggccacgtagaacgtgcccttgagactcggcacgagcaggaacagcggcggctggagcgagcactggctgaggggcagcagcggggagggcagctgcaggagcagctgacacaacagttgtcccaagcactgtcgtcagctgtagctgggcggctagagcgcagcatacgggatgagatcaagaagacagtccctccatgtgtctcaaggagtctggagcctatggcaggccaactgagcaactcagtggctaccaagctcacagctgtggagggcagcatgaaagagaacatctccaagctgctcaagtccaagaacttgactgatgccatcgcccgagcagctgcagacacattacaagggccgatgcaggctgcctaccgggaagccttccagagtgtggtgctgccggcctttgagaagagctgccaggccatgttccagcaaatcaatgatagcttccggctggggacacaggaatacttgcagcagctagaaagccacatgaagagccggaaggcacgggaacaggaggccagggagcctgtgctagcccagctgcggggcctggtcagcacactgcagagtgccactgagcagatggcagccaccgtggccggcagtgttcgtgctgaggtgcagcaccagctgcatgtggctgtgggcagcctgcaggagtccattttagcacaggtacagcgcatcgttaagggtgaggtgagtgtggcgctcaaggagcagcaggccgccgtcacctccagcatcatgcaggccatgcgctcagctgctggcacacctgtcccctctgcccaccttgactgccaggcccagcaagcccatatcctgcagctgctgcagcagggccacctcaatcaggccttccagcaggcgctgacagctgctgacctgaacctggtgctgtatgtgtgtgaaactgtggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttggaataaaatgga

SEQ ID NO: 319420 - DNA, 2484 bp, Homo sapiens
tcggccctgatgttagcttcgtgcctactgccacctctgcactgtccctggagctgcaggaagtggagcccctggggctaccccaagcctcccctagccgcactcgttcccctgatgtcatctcctcagcttccactgccctgtcccaggacatccctgagattgcatctgaggccctgtcccgtggttttggctcctctgcaccagagggccttgagccagacagtatggcttcagccgcctcggcactgcacctgctgtccccacggccccggccagggcccgagctcggcccccagctcgggcttgatggaggccctggggatggagatcggcataataccccctccctcctggaggcagccttgacccaggaggcctcgactcctgacagtcaggtttggcccacagcacctgacattactcgtgagacctgcagcaccctggcagaaagccccaggaatggccttcaggaaaagcacaagagcctggccttccaccgaccaccatatcacctgctgcagcaacgtgacagccaggatgccagtgctgagcaaagtgaccatgatgatgaggtggccagccttgcctctgcttcaggaggctttggcaccaaagttcctgctccacggctgcctgccaaggactggaagaccaagggatcccctcgaacctcacccaagctcaagaggaaaagcaagaaggatgatggggatgcagccatgggatcccggctcacagagcaccaggtggcagagccccctgaggactggccagcactaatttggcaacagcagagagagctggcagagctgcggcacagccaggaagagctgctgcagcgtctgtgtacccaactcgaaggcctgcagagcacagtcacaggccacgtagaacgtgcccttgagactcggcacgagcaggaacagcggcggctggagcgagcactggctgaggggcagcagcggggagggcagctgcaggagcagctgacacaacagttgtcccaagcactgtcgtcagctgtagctgggcggctagagcgcagcatacgggatgagatcaagaagacagtccctccatgtgtctcaaggagtctggagcctatggcaggccaactgagcaactcagtggctaccaagctcacagctgtggagggcagcatgaaagagaacatctccaagctgctcaagtccaagaacttgactgatgccatcgcccgagcagctgcagacacattacaagggccgatgcaggctgcctaccgggaagccttccagagtgtggtgctgccggcctttgagaagagctgccaggccatgttccagcaaatcaatgatagcttccggctggggacacaggaatacttgcagcagctagaaagccacatgaagagccggaaggcacgggaacaggaggccagggagcctgtgctagcccagctgcggggcctggtcagcacactgcagagtgccactgagcagatggcagccaccgtggccggcagtgttcgtgctgaggtgcagcaccagctgcatgtggctgtgggcagcctgcaggagtccattttagcacaggtacagcgcatcgttaagggtgaggtgagtgtggcgctcaaggagcagcaggccgccgtcacctccagcatcatgcaggccatgcgctcagctgctggcacacctgtcccctctgcccaccttgactgccaggcccagcaagcccatatcctgcagctgctgcagcagggccacctcaatcaggccttccagcaggcgctgacagctgctgacctgaacctggtgctgtatgtgtgtgaaactgtggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttggaataaaatgga

SEQ ID NO: 319421 - DNA, 4448 bp, Homo sapiens
tcagcgacgctgcgcgggtggcggtttgcgaactgcgggtggactgtgtagtgaccggcgtcccgctgtctcgccccgtggcgggtgagcgagggtgcgtggtgcgcggcggcggcggaacgaacgcggtgcgggcggggcgcccgccgcagggcccatggcctcctgcgcgagcatcgacatcgaggacgccacgcagcacctgcgggacatcctcaagctggaccggcccgcgggcggccccagtgcagagagcccacggccatccagtgcctacaatggggacctcaatggacttctggtcccagacccgctctgctcaggtgatagtacctcagcaaacaagactggtcttcggaccatgccacccattaacctgcaagagaagcaggtcatctgtctctcaggagatgatagctccacctgcattgggattttggccaaggaggtggagattgtggctagcagtgactctagcatttcaagcaaggcccggggaagcaacaaggtgaaaattcagcctgtcgccaagtatgactgggaacagaagtactactatggcaacctgattgctgtgtctaactccttcttggcctatgccattcgggctgccaacaatggctctgccatggtgcgggtgatcagcgtcagcacttcggagcggaccttgctcaagggcttcacaggcagtgtggctgatctggctttcgcgcacctcaactctccacagctggcctgcctggatgaggcaggcaacctgttcgtgtggcgcttggctctggttaatggcaaaattcaagaagagatcttggtccatattcggcagccagagggcacgccactgaaccactttcgcaggatcatctggtgccccttcatccctgaggagagcgaagactgctgtgaggagagcagcccaacagtggccctgctgcatgaagaccgggctgaggtgtgggacctggacatgctccgctccagccacagtacctggcctgtggatgttagccagatcaagcagggcttcattgtggtaaaaggtcatagcacgtgcctcagtgaaggagccctctctcctgatgggactgtgctggctactgcgagccacgatggctatgtcaagttctggcagatctacattgaggggcaagatgagccaaggtgtctgcacgagtggaaacctcatgatgggcggcccctctcctgcctcctgttctgtgacaaccataagaaacaagaccctgatgtccctttctggaggttccttattactggtgctgaccagaaccgagagttaaagatgtggtgtacagtatcctggacctgcctgcagactattcgcttctccccagatatcttcagctcagtgagtgtgccccctagcctcaaggtttgcttggacctctcagcagaatacctgattctcagcgatgtgcaacggaaggtcctctatgtgatggagctgctgcaaaaccaggaggagggccacgcctgcttcagctccatctcggagttcctgctcacccaccctgtgctgagctttggtatccaggttgtgagtcgctgccggctacggcacactgaggtgctgcctgccgaagaggaaaatgacagcctgggtgctgatggtacccatggagccggtgccatggagtctgcggccggtgtgctcatcaagctcttttgtgtgcatactaaggcactgcaagatgtgcagatccgcttccagccacagctgaaccctgatgtggtggccccactgcccacccacactgcccacgaggacttcacatttggagagtctcggcccgaactgggctctgagggcctggggtcagccgctcacggctcccagcctgacctccgacgaatcgtggagctgcctgcacctgccgacttcctcagtctgagcagtgagaccaagcccaagttgatgacacctgacgccttcatgacacctagcgcctccttgcagcagatcactgcctctcccagcagcagcagcagcggtagcagcagcagcagcagcagtagcagcagctcccttacagctgtgtctgccatgagcagcacctcagctgtggacccctccttgaccaggccacctgaggagctgaccttgagccccaagctgcagctggatggcagcctgacaatgagcagcagtggcagccttcaggcaagcccgcgtggcctcctgcctggcctgctcccagccccagctgacaaactgactcccaaggggccgggccaggtgcctactgccacctctgcactgtccctggagctgcaggaagtggagcccctggggctaccccaagcctcccctagccgcactcgttcccctgatgtcatctcctcagcttccactgccctgtcccaggacatccctgagattgcatctgaggccctgtcccgtggttttggctcctctgcaccagagggccttgagccagacagtatggcttcagccgcctcggcactgcacctgctgtccccacggccccggccagggcccgagctcggcccccagctcgggcttgatggaggccctggggatggagatcggcataataccccctccctcctggaggcagccttgacccaggaggcctcgactcctgacagtcaggtttggcccacagcacctgacattactcgtgagacctgcagcaccctggcagaaagccccaggaatggccttcaggaaaagcacaagagcctggccttccaccgaccaccatatcacctgctgcagcaacgtgacagccaggatgccagtgctgagcaaagtgaccatgatgatgaggtggccagccttgcctctgcttcaggaggctttggcaccaaagttcctgctccacggctgcctgccaaggactggaagaccaagggatcccctcgaacctcacccaagctcaagaggaaaagcaagaaggatgatggggatgcagccatgggatcccggctcacagagcaccaggtggcagagccccctgaggactggccagcactaatttggcaacagcagagagagctggcagagctgcggcacagccaggaagagctgctgcagcgtctgtgtacccaactcgaaggcctgcagagcacagtcacaggccacgtagaacgtgcccttgagactcggcacgagcaggaacagcggcggctggagcgagcactggctgaggggcagcagcggggagggcagctgcaggagcagctgacacaacagttgtcccaagcactgtcgtcagctgtagctgggcggctagagcgcagcatacgggatgagatcaagaagacagtccctccatgtgtctcaaggagtctggagcctatggcaggccaactgagcaactcagtggctaccaagctcacagctgtggagggcagcatgaaagagaacatctccaagctgctcaagtccaagaacttgactgatgccatcgcccgagcagctgcagacacattacaagggccgatgcaggctgcctaccgggaagccttccagagtgtggtgctgccggcctttgagaagagctgccaggccatgttccagcaaatcaatgatagcttccggctggggacacaggaatacttgcagcagctagaaagccacatgaagagccggaaggcacgggaacaggaggccagggagcctgtgctagcccagcagcaagcccatatcctgcagctgctgcagcagggccacctcaatcaggccttccagcaggcgctgacagctgctgacctgaacctggtgctgtatgtgtgtgaaactgtggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttggaataaaatgga

SEQ ID NO: 319422 - DNA, 4942 bp, Homo sapiens
tcagcgacgctgcgcgggtggcggtttgcgaactgcgggtggactgtgtagtgaccggcgtcccgctgtctcgccccgtggcgggtgagcgagggtgcgtggtgcgcggcggcggcggaacgaacgcggtgcgggcggggcgcccgccgcagggcccatggcctcctgcgcgagcatcgacatcgaggacgccacgcagcacctgcgggacatcctcaagctggaccggcccgcgggcggccccagtgcagagagcccacggccatccagtgcctacaatggggacctcaatggacttctggtcccagacccgctctgctcaggtgatagtacctcagcaaacaagactggtcttcggaccatgccacccattaacctgcaagagaagcaggtcatctgtctctcaggagatgatagctccacctgcattgggattttggccaaggaggtggagattgtggctagcagtgactctagcatttcaagcaaggcccggggaagcaacaaggtgaaaattcagcctgtcgccaagtatgactgggaacagaagtactactatggcaacctgattgctgtgtctaactccttcttggcctatgccattcgggctgccaacaatggctctgccatggtgcgggtgatcagcgtcagcacttcggagcggaccttgctcaagggcttcacaggcagtgtggctgatctggctttcgcgcacctcaactctccacagctggcctgcctggatgaggcaggcaacctgttcgtgtggcgcttggctctggttaatggcaaaattcaagaagagatcttggtccatattcggcagccagagggcacgccactgaaccactttcgcaggatcatctggtgccccttcatccctgaggagagcgaagactgctgtgaggagagcagcccaacagtggccctgctgcatgaagaccgggctgaggtgtgggacctggacatgctccgctccagccacagtacctggcctgtggatgttagccagatcaagcagggcttcattgtggtaaaaggtcatagcacgtgcctcagtgaaggagccctctctcctgatgggactgtgctggctactgcgagccacgatggctatgtcaagttctggcagatctacattgaggggcaagatgagccaaggtgtctgcacgagtggaaacctcatgatgggcggcccctctcctgcctcctgttctgtgacaaccataagaaacaagaccctgatgtccctttctggaggttccttattactggtgctgaccagaaccgagagttaaagatgtggtgtacagtatcctggacctgcctgcagactattcgcttctccccagatatcttcagctcagtgagtgtgccccctagcctcaaggtttgcttggacctctcagcagaatacctgattctcagcgatgtgcaacggaaggtcctctatgtgatggagctgctgcaaaaccaggaggagggccacgcctgcttcagctccatctcggagttcctgctcacccaccctgtgctgagctttggtatccaggttgtgagtcgctgccggctacggcacactgaggtgctgcctgccgaagaggaaaatgacagcctgggtgctgatggtacccatggagccggtgccatggagtctgcggccggtgtgctcatcaagctcttttgtgtgcatactaaggcactgcaagatgtgcagatccgcttccagccacagctgaaccctgatgtggtggccccactgcccacccacactgcccacgaggacttcacatttggagagtctcggcccgaactgggctctgagggcctggggtcagccgctcacggctcccagcctgacctccgacgaatcgtggagctgcctgcacctgccgacttcctcagtctgagcagtgagaccaagcccaagttgatgacacctgacgccttcatgacacctagcgcctccttgcagcagatcactgcctctcccagcagcagcagcagcggtagcagcagcagcagcagcagtagcagcagctcccttacagctgtgtctgccatgagcagcacctcagctgtggacccctccttgaccaggccacctgaggagctgaccttgagccccaagctgcagctggatggcagcctgacaatgagcagcagtggcagccttcaggcaagcccgcgtggcctcctgcctggcctgctcccagccccagctgacaaactgactcccaaggggccgggccaggtgcctactgccacctctgcactgtccctggagctgcaggaagtggagcccctggggctaccccaagcctcccctagccgcactcgttcccctgatgtcatctcctcagcttccactgccctgtcccaggacatccctgagattgcatctgaggccctgtcccgtggttttggctcctctgcaccagagggccttgagccagacagtatggcttcagccgcctcggcactgcacctgctgtccccacggccccggccagggcccgagctcggcccccagctcgggcttgatggaggccctggggatggagatcggcataataccccctccctcctggaggcagccttgacccaggaggcctcgactcctgacagtcaggtttggcccacagcacctgacattactcgtgagacctgcagcaccctggcagaaagccccaggaatggccttcaggaaaagcacaagagcctggccttccaccgaccaccatatcacctgctgcagcaacgtgacagccaggatgccagtgctgagcaaagtgaccatgatgatgaggtggccagccttgcctctgcttcaggaggctttggcaccaaagttcctgctccacggctgcctgccaaggactggaagaccaagggatcccctcgaacctcacccaagctcaagaggaaaagcaagaaggatgatggggatgcagccatgggatcccggctcacagagcaccaggtggcagagccccctgaggactggccagcactaatttggcaacagcagagagagctggcagagctgcggcacagccaggaagagctgctgcagcgtctgtgtacccaactcgaaggcctgcagagcacagtcacaggccacgtagaacgtgcccttgagactcggcacgagcaggaacagcggcggctggagcgagcactggctgaggggcagcagcggggagggcagctgcaggagcagctgacacaacagttgtcccaagcactgtcgtcagctgtagctgggcggctagagcgcagcatacgggatgagatcaagaagacagtccctccatgtgtctcaaggagtctggagcctatggcaggccaactgagcaactcagtggctaccaagctcacagctgtggagggcagcatgaaagagaacatctccaagctgctcaagtccaagaacttgactgatgccatcgcccgagcagctgcagacacattacaagggccgatgcaggctgcctaccgggaagccttccagagtgtggtgctgccggcctttgagaagagctgccaggccatgttccagcaaatcaatgatagcttccggctggggacacaggaatacttgcagcagctagaaagccacatgaagagccggaaggcacgggaacaggaggccagggagcctgtgctagcccagctgcggggcctggtcagcacactgcagagtgccactgagcagatggcagccaccgtggccggcagtgttcgtgctgaggtgcagcaccagctgcatgtggctgtgggcagcctgcaggagtccattttagcacaggtacagcgcatcgttaagggtgaggtgagtgtggcgctcaaggagcagcaggccgccgtcacctccagcatcatgcaggccatgcgctcagctgctggcacacctgtcccctctgcccaccttgactgccaggcccagcaagcccatatcctgcagctgctgcagcagggccacctcaatcaggccttccagcaggcgctgacagctgctgacctgaacctggtgctgtatgtgtgtgaaactgtggacccagcccaggtttttgggcagccaccctgcccgctctcccagcctgtgctcctttccctcatccagcagctggcatctgaccttggcactcgaactgacctcaagctcaggtaagtggggacagccagggatggggagatgagctggggagtggggcagtgggagggagcagtttgaagctgacgcccacttctgcctgaatcctctccctaattttctccaccagtcctttctgccttcacccagagggttccctctgggcctcggtgccaccagggggcgctcccgtctgctggcacccacctgtagcctgtcctttcccccccatccccagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttggaataaaatgga

SEQ ID NO: 319423 - DNA, 1170 bp, Homo sapiens
ttcgcttctccacccacccctcaaaatggcatgttcaggcagtggggcccctacccctggaccatgaaggctccatgaagagccggaaggcacgggaacaggaggccagggagcctgtgctagcccagctgcggggcctggtcagcacactgcagagtgccactgagcagatggcagccaccgtggccggcagtgttcgtgctgaggtgcagcaccagctgcatgtggctgtgggcagcctgcaggagtccattttagcacaggtacagcgcatcgttaagggtgaggtgagtgtggcgctcaaggagcagcaggccgccgtcacctccagcatcatgcaggccatgcgctcagctgctggcacacctgtcccctctgcccaccttgactgccaggcccagcaagcccatatcctgcagctgctgcagcagggccacctcaatcaggccttccagcaggcgctgacagctgctgacctgaacctggtgctgtatgtgtgtgaaactgtggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttggaataaaatgga

SEQ ID NO: 319424 - DNA, 4822 bp, Homo sapiens
tcagcgacgctgcgcgggtggcggtttgcgaactgcgggtggactgtgtagtgaccggcgtcccgctgtctcgccccgtggcgggtgagcgagggtgcgtggtgcgcggcggcggcggaacgaacgcggtgcgggcggggcgcccgccgcagggcccatggcctcctgcgcgagcatcgacatcgaggacgccacgcagcacctgcgggacatcctcaagctggaccggcccgcgggcggccccagtgcagagagcccacggccatccagtgcctacaatggggacctcaatggacttctggtcccagacccgctctgctcaggtgatagtacctcagcaaacaagactggtcttcggaccatgccacccattaacctgcaagagaagcaggtcatctgtctctcaggagatgatagctccacctgcattgggattttggccaaggaggtggagattgtggctagcagtgactctagcatttcaagcaaggcccggggaagcaacaaggtgaaaattcagcctgtcgccaagtatgactgggaacagaagtactactatggcaacctgattgctgtgtctaactccttcttggcctatgccattcgggctgccaacaatggctctgccatggtgcgggtgatcagcgtcagcacttcggagcggaccttgctcaagggcttcacaggcagtgtggctgatctggctttcgcgcacctcaactctccacagctggcctgcctggatgaggcaggcaacctgttcgtgtggcgcttggctctggttaatggcaaaattcaagaagagatcttggtccatattcggcagccagagggcacgccactgaaccactttcgcaggatcatctggtgccccttcatccctgaggagagcgaagactgctgtgaggagagcagcccaacagtggccctgctgcatgaagaccgggctgaggtgtgggacctggacatgctccgctccagccacagtacctggcctgtggatgttagccagatcaagcagggcttcattgtggtaaaaggtcatagcacgtgcctcagtgaaggagccctctctcctgatgggactgtgctggctactgcgagccacgatggctatgtcaagttctggcagatctacattgaggggcaagatgagccaaggtgtctgcacgagtggaaacctcatgatgggcggcccctctcctgcctcctgttctgtgacaaccataagaaacaagaccctgatgtccctttctggaggttccttattactggtgctgaccagaaccgagagttaaagatgtggtgtacagtatcctggacctgcctgcagactattcgcttctccccagatatcttcagctcagtgagtgtgccccctagcctcaaggtttgcttggacctctcagcagaatacctgattctcagcgatgtgcaacggaaggtcctctatgtgatggagctgctgcaaaaccaggaggagggccacgcctgcttcagctccatctcggagttcctgctcacccaccctgtgctgagctttggtatccaggttgtgagtcgctgccggctacggcacactgaggtgctgcctgccgaagaggaaaatgacagcctgggtgctgatggtacccatggagccggtgccatggagtctgcggccggtgtgctcatcaagctcttttgtgtgcatactaaggcactgcaagatgtgcagatccgcttccagccacagctgaaccctgatgtggtggccccactgcccacccacactgcccacgaggacttcacatttggagagtctcggcccgaactgggctctgagggcctggggtcagccgctcacggctcccagcctgacctccgacgaatcgtggagctgcctgcacctgccgacttcctcagtctgagcagtgagaccaagcccaagttgatgacacctgacgccttcatgacacctagcgcctccttgcagcagatcactgcctctcccagcagcagcagcagcggtagcagcagcagcagcagcagtagcagcagctcccttacagctgtgtctgccatgagcagcacctcagctgtggacccctccttgaccaggccacctgaggagctgaccttgagccccaagctgcagctggatggcagcctgacaatgagcagcagtggcagccttcaggcaagcccgcgtggcctcctgcctggcctgctcccagccccagctgacaaactgactcccaaggggccgggccaggtgcctactgccacctctgcactgtccctggagctgcaggaagtggagcccctggggctaccccaagcctcccctagccgcactcgttcccctgatgtcatctcctcagcttccactgccctgtcccaggacatccctgagattgcatctgaggccctgtcccgtggttttggctcctctgcaccagagggccttgagccagacagtatggcttcagccgcctcggcactgcacctgctgtccccacggccccggccagggcccgagctcggcccccagctcgggcttgatggaggccctggggatggagatcggcataataccccctccctcctggaggcagccttgacccaggaggcctcgactcctgacagtcaggtttggcccacagcacctgacattactcgtgagacctgcagcaccctggcagaaagccccaggaatggccttcaggaaaagcacaagagcctggccttccaccgaccaccatatcacctgctgcagcaacgtgacagccaggatgccagtgctgagcaaagtgaccatgatgatgaggtggccagccttgcctctgcttcaggaggctttggcaccaaagttcctgctccacggctgcctgccaaggactggaagaccaagggatcccctcgaacctcacccaagctcaagaggaaaagcaagaaggatgatggggatgcagccatgggatcccggctcacagagcaccaggtggcagagccccctgaggactggccagcactaatttggcaacagcagagagagctggcagagctgcggcacagccaggaagagctgctgcagcgtctgtgtacccaactcgaaggcctgcagagcacagtcacaggccacgtagaacgtgcccttgagactcggcacgagcaggaacagcggcggctggagcgagcactggctgaggggcagcagcggggagggcagctgcaggagcagctgacacaacagttgtcccaagcactgtcgtcagctgtagctgggcggctagagcgcagcatacgggatgagatcaagaagacagtccctccatgtgtctcaaggagtctggagcctatggcaggccaactgagcaactcagtggctaccaagctcacagctgtggagggcagcatgaaagagaacatctccaagctgctcaagtccaagaacttgactgatgccatcgcccgagcagctgcagacacattacaagggccgatgcaggctgcctaccgggaagccttccagagtgtggtgctgccggcctttgagaagagctgccaggccatgttccagcaaatcaatgatagcttccggctggggacacaggaatacttgcagcagctagaaagccacatgaagagccggaaggcacgggaacaggaggccagggagcctgtgctagcccagctgcggggcctggtcagcacactgcagagtgccactgagcagatggcagccaccgtggccggcagtgttcgtgctgaggtgcagcaccagctgcatgtggctgtgggcagcctgcaggagtccattttagcacaggtacagcgcatcgttaagggtgaggtgagtgtggcgctcaaggagcagcaggccgccgtcacctccagcatcatgcaggccatgcgctcagctgctggcacacctgtcccctctgcccaccttgactgccaggcccagcaagcccatatcctgcagctgctgcagcagggccacctcaatcaggccttccagcaggcgctgacagctgctgacctgaacctggtgctgtatgtgtgtgaaactgtggacccagcccaggtttttgggcagccaccctgcccgctctcccagcctgtgctcctttccctcatccagcagctggcatctgaccttggcactcgaactgacctcaagctcagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttggaataaaatggagtatgtgtgtgcttttggtttgtctttggtgtgactctcataactgccgtctgttcgttctctgcccatctcttgcccgtggagctctgtcgaggccaacccag

SEQ ID NO: 319425 - DNA, 3085 bp, Homo sapiens
tcagcgacgctgcgcgggtggcggtttgcgaactgcgggtggactgtgtagtgaccggcgtcccgctgtctcgccccgtggcgggtgagcgagggtgcgtggtgcgcggcggcggcggaacgaacgcggtgcgggcggggcgcccgccgcagggcccatggcctcctgcgcgagcatcgacatcgaggacgccacgcagcacctgcgggacatcctcaagctggaccggcccgcgggcggccccagtgcagagagcccacggccatccagtgcctacaatggggacctcaatggacttctggtcccagacccgctctgctcaggtgatagtacctcagcaaacaagactggtcttcggaccatgccacccattaacctgcaagagaagcaggtcatctgtctctcaggagatgatagctccacctgcattgggattttggccaaggaggtggagattgtggctagcagtgactctagcatttcaagcaaggcccggggaagcaacaaggtgaaaattcagcctgtcgccaagtatgactgggaacagaagtactactatggcaacctgattgctgtgtctaactccttcttggcctatgccattcgggctgccaacaatggctctgccatggtgcgggtgatcagcgtcagcacttcggagcggaccttgctcaagggcttcacaggcagtgtggctgatctggctttcgcgcacctcaactctccacagctggcctgcctggatgaggcaggcaacctgttcgtgtggcgcttggctctggttaatggcaaaattcaagaagagatcttggtccatattcggcagccagagggcacgccactgaaccactttcgcaggatcatctggtgccccttcatccctgaggagagcgaagactgctgtgaggagagcagcccaacagtggccctgctgcatgaagaccgggctgaggtgtgggacctggacatgctccgctccagccacagtacctggcctgtggatgttagccagatcaagcagggcttcattgtggtaaaaggtcatagcacgtgcctcagtgaaggagccctctctcctgatgggactgtgctggctactgcgagccacgatggctatgtcaagttctggcagatctacattgaggggcaagatgagccaaggtgtctgcacgagtggaaacctcatgatgggcggcccctctcctgcctcctgttctgtgacaaccataagaaacaagaccctgatgtccctttctggaggttccttattactggtgctgaccagaaccgagagttaaagatgtggtgtacagtatcctggacctgcctgcagactattcgcttctccccagatatcttcagctcagtgagtgtgccccctagcctcaaggtttgcttggacctctcagcagaatacctgattctcagcgatgtgcaacggaaggtcctctatgtgatggagctgctgcaaaaccaggaggagggccacgcctgcttcagctccatctcggagttcctgctcacccaccctgtgctgagctttggtatccaggttgtgagtcgctgccggctacggcacactgaggtgctgcctgccgaagaggaaaatgacagcctgggtgctgatggtacccatggagccggtgccatggagtctgcggccggtgtgctcatcaagctcttttgtgtgcatactaaggcactgcaagatgtgcagatccgcttccagccacagctgaaccctgatgtggtggccccactgcccacccacactgcccacgaggacttcacatttggagagtctcggcccgaactgggctctgagggcctggggtcagccgctcacggctcccagcctgacctccgacgaatcgtggagctgcctgcacctgccgacttcctcagtctgagcagtgagaccaagcccaagttgatgacacctgacgccttcatgacacctagcgcctccttgcagcagatcactgcctctcccagcagcagcagcagcggtagcagcagcagcagcagcagtagcagcagctcccttacagctgtgtctgccatgagcagcacctcagctgtggacccctccttgaccaggccacctgaggagctgaccttgagccccaagctgcagctggatggcagcctgacaatgagcagcagtggcagccttcaggcaagcccgcgtggcctcctgcctggcctgctcccagccccagctgacaaactgactcccaaggggccgggccaggtgcctactgccacctctgcactgtccctggagctgcaggaagtggagcccctggggctaccccaagcctcccctagccgcactcgttcccctgatgtcatctcctcagcttccactgccctgtcccaggacatccctgagattgcatctgaggccctgtcccgtggttttggctcctctgcaccagagggccttgagccagacagtatggcttcagccgcctcggcactgcacctgctgtccccacggccccggccagggcccgagctcggcccccagctcgggcttgatggaggccctggggatggagatcggcataataccccctccctcctggaggcagccttgacccaggaggcctcgactcctgacagtcaggtttggcccacagcacctgacattactcgtgagacctgcagcaccctggcagaaagccccaggaatggccttcaggaaaagcacaagagcctggccttccaccgaccaccatatcacctgctgcagcaacgtgacagccaggatgccagtgctgagcaaagtgaccatgatgatgaggtggccagccttgcctctgcttcaggaggctttggcaccaaagttcctgctccacggctgcctgccaaggactggaagaccaagggatcccctcgaacctcacccaagctcaagaggaaaagcaagaaggatgatgggggatccgccctgggatcccggctcacagagcaccagggggaaaaccccttgaggactgcccaacattaatttgcaaccaaaaaaaaactggcaaacttggcacaaccagaagaactcttgcacttttggaccccaatt

SEQ ID NO: 319426 - DNA, 741 bp, Homo sapiens
cgaaattaacactgaccttacaacatatttcatttgtggacaaagacacagtaaatgtgaggaaactacagaattgctatgactggagctaaatgaatagctctgaagtcagtgtcccatatttgcatatagatattcagaccaggcttgaggctgggtgtggtggcgcacacctgtaatcccagctacttgggaggctgaggcaggagaatcacttgaacctgggaggcggaggttgcagtgagctgagatggcatcactgcactccagcctgggtgacagggtgacactccacctcaaaaaataaaaataaaataaaaataaagttatgctactcctaaaccacttaatatatgttttgtggttttcaaaattatgtaatcagccctgaaacacattggttgaaaatattttgagactttataagttagtatttattaaattaatattattttaataagttttgttaaatcctagtttaaatgacaaagctgtgtatagagtaggggtgactgaaggtggagtactcttgaggtggcgataaaaatgtacccataaatttaaagtccattctgtaattggaatactgaatgtcctgtgtgtggtgaacattttctaggtgattagaattgcatttcactggctgcatttgtttgtggtatgtaagatagctagaaatttattacttaactctgtggggcattgtttagatactgtgaagagttgaggtaaatatgtgtc

SEQ ID NO: 319427 - DNA, 153 bp, Homo sapiens
tctaaagaaatcttaattttaccagtttaaaaaaaacgcttctttttaaaagttcatgtttctaacctttaacaattcagttaataggaaaggagtaacttttaaatcaagctttaaaacatggaaatttaagccagtatgttagatattttt

SEQ ID NO: 319428 - DNA, 526 bp, Homo sapiens
agctgtgtatagagtaggggtgactgaaggtggagtactcttgaggtggcgataaaaatgtacccataaatttaaagtccattctgtaattggaatactgaatgtcctgtgtgtggtgaacattttctaggtgattagaattgcatttcactggctgcatttgtttgtggtatgtaagatagctagaaatttattacttaactctgtggggcattgtttagatactgtgaagagttgaggtaaatatgtgtcttgtaaaagctttgtgtgatcagaatattttggtaattataaaatgtttttgatgatacacatttaactctgttagtaattactctaaagaaatcttaattttaccagtttaaaaaaaacgcttctttttaaaagttcatgtttctaacctttaacaattcagttaataggaaaggagtaacttttaaatcaagctttaaaacatggaaatttaagccagtatgttagatattttttctatcccaccctaccatgataataaaaataaatctat

SEQ ID NO: 319429 - DNA, 616 bp, Homo sapiens
gtgcacgtgtggtagggtttatttaaggtttctaccagccatgaatttgctgggtcaaaggatactgcattgtaaactttgttaaataacttcaaattgttctccaaagtaggcaaatcagtgaacgctgtagttgcattactttattgtctaccttgtgtcagccttctctaattgctagtgagcttttgcgtcttttcatacattgtctcttcaagtgtactcttccatgaattgctggttaatattctgtgcccatttttctaggtgccaaatgctaatcttgggatcaattgggatatacctatgagcaaaataaagagcactactcttagagtttaccttctagcaagaggaaatgtattatgaagaataaacataataaacaagtgcattttatagcacaatagaaggtgataaatactaccggaaaaaagacaaagtaggacagggtaatgtgaaggggattggggccacagagtaggcaaaacattttattgtattaaatagggtggtcaaggtgggcctctttgagaaggcaggatttgagtcaagatgaggaagtaaagaacagcaagaggtcagtgagtcagaagtggagacacagaagagaaga

SEQ ID NO: 319430 - DNA, 666 bp, Homo sapiens
acggggatgatttataagtttggtttctgtcacgtcaggtgctgtgccggcgcttgagataggaaatgtaaaagacaacgtgcgcctcaattcacagtctcgtgagagagacagacaattatattacagcgtgaataaatatcatgaagtcggcggatgtggagaagtgaggcttcggggcacggggtctgggcgctggccggttgctggcccagggcgggaggcagggcgaactctgtgcagcccctccccttttccctgaggcggaggttcggtccctccggaccggacctttgattgacaacttcgataaataatccagtcacacttccgggccctttggttggggatcgccaggcgctgctttcgtcaactgtcaatccgcctgggtttgagtagagtgtgactgttctggtggactttcccctcaccaaacgtctcctcctgcctcagcctgcaccacctttctttctgggtggctgttgcctgttttcttaggggttaatgacggggatgatttataagtttggtttctgtcacgtcaggtgctgtgcccggcgcttgagataggaaatgtaaaagacaacgtgcgcctcaattcacagtctcgtgagagagacagacaattatattacagcgtgaataaatgtaatgaagatgtataca

SEQ ID NO: 319431 - DNA, 3032 bp, Homo sapiens
gggtcggccggcagggggcggggccgggcatggtaacggctcggaagcctaggaggctgggccggagggaggcggaggaaccggtgttcgccgccgccgctgcttcagcttattccttgtggcctctgcgggtcctgcctcagccatgatgatccacggcttccagagcagccaccgggatttctgcttcgggccctggaagctgacggcgtccaagacccacatcatgaagtcggcggatgtggagaaattagccgatgaattacatatgccatctctccctgaaatgatgtttggagacaacgttttaagaatccagcatgggtctggctttggaattgagttcaatgctacagatgcgttaagatgtgtaaacaactaccaaggaatgcttaaagtggcctgtgctgaagagtggcaagaaagcaggacggagggtgaacactccaaagaggttattaaaccatatgattggacctatacaacagattataagggaaccttacttggagaatctcttaagttaaaggttgtacctacaacagatcatatagatacagaaaaattgaaagccagagaacagattaagttttttgaagaagttctcctttttgaggatgaacttcatgatcatggagtttcaagcctgagtgtgaagattagagtaatgccttctagctttttcctgctgttgcggtttttcttgagaattgatggggtgcttatcagaatgaatgacacgagactttaccatgaggctgacaagacctacatgttacgagaatatacgtcacgagaaagcaaaatttctagtttgatgcatgttccaccttccctcttcacggaacctaatgaaatatcccagtatttaccaataaaggaagcagtttgtgagaagctaatatttccagaaagaattgatcctaacccagcagactcacaaaaaagtacacaagtggaataaaatgtgatacaacatatactcactatggaatctgactggacaccttggctatttgtaaggggttatttttattatgagaattaattgccttgtttatgtacagattttctgtagccttaaaggaaaaaaaaataaagatcgttacaggcaggtttcactcaactgctatttgtactgtctgtcttcacattcatattccagatttatattttctggagttaaatttggatgatttctaaattatcacaaagtgggacctcagcagtagtgatgtgtgtgtctcatgagcagtgagcacagtctgcattcatcatgaaacactatcttctaccaggaggaggttaatgtaaatcaccaaatcccaatgccttgtgactttcataggattcctgatcatgcatgttgatgtactggctcttcactttgggctttctgatgtttattcacacctttggagagttgcaacttgccacatacgaaattagtctcatagtgtagtgaacttcaaccccaaaattttaaaaatgtatttccccccagttttaaattgcctttgaaatttaaaaaaaaaaatttagacttagtaccagaaccaaaaatacctagatttttggagaacttattacatacatagaaacatgaatatggtttaccactgtgtgtgtgtaggatgttagaattatctgtcctccatctttaggtgctttttcttaaatgtggttctacttatactgatatttttaatttccatcttccatgcaacctcagagtgaataaaccccttaaatttggtgctggttcgaaaaagtctaaagggtttattaggggttgtttttcgcaaatattacatcaatccttaaagcaacaagattaattttctgcttaaaatatttgggaagataggtaaggaggagggggttttaaaatataaaagcaagtttttctattttaaggtgcatatttgtaacattacaggggatgaagtaaaatgtaattaattagcacaagacttagggagtacagaaaatacacagaagtaaatttcaaatccatttgattgttttcatagtgaccccttagtcattttatattcttgtctgcctttctagaaaaatggttgtcataaagtggaaagtgattaaaaagcatcaaataagaaattatttcaagtggatttttaaaaatatttttttgaagggcagggggaaaattcaccccttttctgatttgaaatatgttgtacatatttccatttgatggataaatcattaagtaagaatatttgatttaaagtattagccaacctcttcaggtattagcctgaagataaattttaacaaaacatatacacttgggtatccgtcattgctcaaactctatagtgtattgctggagccaataggcagggtatattttattagctaaatttgatatttgtcttctgccttctgtatcacctccaagctataggaaatcaggattttgttggctttaagaaaacacatggtatgttcactgtatattaaatatacctgtatttaatgttttctcttaggacagaaaagtagacacacacacacacacacacatgttgtgttcagctttctgttttatattatttgccattgagattagaatagaacaggctctattcatgcaaactatatgaaatgaaaaacttttaagactcttcattaattggagcttctgggcaacatcgtgtgtgtgtgtgtgtgtgtgtgtgtgtgtgtgtgtatacagacattttttttttaacttgttgattcagatgtcttggtccctgaatagtcctagattacttattttgagaattcattgttaaaaattacagggaattaaaataattgcctttttttttttagagggtaagagatgggtagaagagtatgcctctgaaaattttattagtttattcttgtggagaataccaagaaaatgtgtatttgcccattgctaaatatgatatatgccattttgtatttatttgtcccaagtgtctttttgtaagaggagaataaacaataaggaattactgatcaaaaaaaac

SEQ ID NO: 319432 - DNA, 1956 bp, Homo sapiens
gggtcggccggcagggggcggggccgggcatggtaacggctcggaagcctaggaggctgggccggagggaggcggaggaaccggtgttcgccgccgccgctgcttcagcttattccttgtggcctctgcgggtcctgcctcagccatgatgatccacggcttccagagcagccaccgggatttctgcttcgggccctggaagctgacggcgtccaagacccacatcatgaagtcggcggatgtggagaaattagccgatgaattacatatgccatctctccctgaaatgatgtttggagacaacgttttaagaatccagcatgggtctggctttggaattgagttcaatgctacagatgcgttaagatgtgtaaacaactaccaaggaatgcttaaagtggcctgtgctgaagagtggcaagaaagcaggacggagggtgaacactccaaagaggttattaaaccatatgattggacctatacaacagattataagggaaccttacttggagaatctcttaagttaaaggttgtacctacaacagatcatatagatacagaaaaattgaaagccagagaacagattaagttttttgaagaagttctcctttttgaggatgaacttcatgatcatggagtttcaagcctgagtgtgaagattagagtaatgccttctagctttttcctgctgttgcggtttttcttgagaattgatggggtgcttatcagaatgaatgacacgagactttaccatgaggctgacaagacctacatgttacgagaatatacgtcacgagaaagcaaaatttctagtttgatgcatgttccaccttccctcttcacggaacctaatgaaatatcccagtatttaccaataaaggaagcagtttgtgagaagctaatatttccagaaagaattgatcctaacccagcagactcacaaaaaagtacacaagtggaataaaatgtgatacaacatatactcactatggaatctgactggacaccttggctatttgtaaggggttatttttattatgagaattaattgccttgtttatgtacagattttctgtagccttaaaggaaaaaaaaataaagatcgttacaggcaggtttcactcaactgctatttgtactgtctgtcttcacattcatattccagatttatattttctggagttaaatttggatgatttctaaattatcacaaagtgggacctcagcagtagtgatgtgtgtgtctcatgagcagtgagcacagtctgcattcatcatgaaacactatcttctaccaggaggaggttaatgtaaatcaccaaatcccaatgccttgtgactttcataggattcctgatcatgcatgttgatgtactggctcttcactttgggctttctgatgtttattcacacctttggagagttgcaacttgccacatacgaaattagtctcatagtgtagtgaacttcaaccccaaaattttaaaaatgtatttccccccagttttaaattgcctttgaaatttaaaaaaaaaaatttagacttagtaccagaaccaaaaatacctagatttttggagaacttattacatacatagaaacatgaatatggtttaccactgtgtgtgtgtgtgtgtgtgtgtatacagacattttttttttaacttgttgattcagatgtcttggtccctgaatagtcctagattacttattttgagaattcattgttaaaaattacagggaattaaaataattgcctttttttttttagagggtaagagatgggtagaagagtatgcctctgaaaattttattagtttattcttgtggagaataccaagaaaatgtgtatttgcccattgctaaatatgatatatgccattttgtatttatttgtcccaagtgtctttttgtaagaggagaataaacaataaggaattactgatcaaaaaaaac

SEQ ID NO: 319433 - DNA, 816 bp, Homo sapiens
gggtcggccggcagggggcggggccgggcatggtaacggctcggaagcctaggaggctgggccggagggaggcggaggaaccggtgttcgccgccgccgctgcttcagcttattccttgtggcctctgcgggtcctgcctcagccatgatgatccacggcttccagagcagccaccgggatttctgcttcgggccctggaagctgacggcgtccaagacccacatcatgaagtcggcggatgtggagaaattagccgatgaattacatatgccatctctccctgaaatgatgtttggagacaacgttttaagaatccagcatgggtctggctttggaattgagttcaatgctacagatgcgttaagatgtgtaaacaactaccaaggaatgcttaaagtggcctgtgctgaagagtggcaagaaagcaggacggagggtgaacactccaaagaggttattaaaccatatgattggacctatacaacagattataagggaaccttacttggagaatctcttaagttaaaggttgtacctacaacagatcatatagatacagaaaaattgaaagccagagaacagattaagttttttgaagaagttctcctttttgaggatgaacttcatgatcatggagtttcaagcctgagtgtgaagattcctggtggcgggcacctgtagtcccagctactcgggaggctgaggcaggagaagcgtgaacccgggaggcggagcttgcagtgagctgagatcgcaccactgcactccagccctccagcctgggcgacagagcaagactccgtctcaaaaaaaaa

SEQ ID NO: 319434 - DNA, 2426 bp, Homo sapiens
atggccggtgagaggattgcttgatcccaggagttcaaggctgagtgtgaagattagagtaatgccttctagctttttcctgctgttgcggtttttcttgagaattgatggggtgcttatcagaatgaatgacacgagactttaccatgaggctgacaagacctacatgttacgagaatatacgtcacgagaaagcaaaatttctagtttgatgcatgttccaccttccctcttcacggaacctaatgaaatatcccagtatttaccaataaaggaagcagtttgtgagaagctaatatttccagaaagaattgatcctaacccagcagactcacaaaaaagtacacaagtggaataaaatgtgatacaacatatactcactatggaatctgactggacaccttggctatttgtaaggggttatttttattatgagaattaattgccttgtttatgtacagattttctgtagccttaaaggaaaaaaaaataaagatcgttacaggcaggtttcactcaactgctatttgtactgtctgtcttcacattcatattccagatttatattttctggagttaaatttggatgatttctaaattatcacaaagtgggacctcagcagtagtgatgtgtgtgtctcatgagcagtgagcacagtctgcattcatcatgaaacactatcttctaccaggaggaggttaatgtaaatcaccaaatcccaatgccttgtgactttcataggattcctgatcatgcatgttgatgtactggctcttcactttgggctttctgatgtttattcacacctttggagagttgcaacttgccacatacgaaattagtctcatagtgtagtgaacttcaaccccaaaattttaaaaatgtatttccccccagttttaaattgcctttgaaatttaaaaaaaaaaatttagacttagtaccagaaccaaaaatacctagatttttggagaacttattacatacatagaaacatgaatatggtttaccactgtgtgtgtgtaggatgttagaattatctgtcctccatctttaggtgctttttcttaaatgtggttctacttatactgatatttttaatttccatcttccatgcaacctcagagtgaataaaccccttaaatttggtgctggttcgaaaaagtctaaagggtttattaggggttgtttttcgcaaatattacatcaatccttaaagcaacaagattaattttctgcttaaaatatttgggaagataggtaaggaggagggggttttaaaatataaaagcaagtttttctattttaaggtgcatatttgtaacattacaggggatgaagtaaaatgtaattaattagcacaagacttagggagtacagaaaatacacagaagtaaatttcaaatccatttgattgttttcatagtgaccccttagtcattttatattcttgtctgcctttctagaaaaatggttgtcataaagtggaaagtgattaaaaagcatcaaataagaaattatttcaagtggatttttaaaaatatttttttgaagggcagggggaaaattcaccccttttctgatttgaaatatgttgtacatatttccatttgatggataaatcattaagtaagaatatttgatttaaagtattagccaacctcttcaggtattagcctgaagataaattttaacaaaacatatacacttgggtatccgtcattgctcaaactctatagtgtattgctggagccaataggcagggtatattttattagctaaatttgatatttgtcttctgccttctgtatcacctccaagctataggaaatcaggattttgttggctttaagaaaacacatggtatgttcactgtatattaaatatacctgtatttaatgttttctcttaggacagaaaagtagacacacacacacacacacacatgttgtgttcagctttctgttttatattatttgccattgagattagaatagaacaggctctattcatgcaaactatatgaaatgaaaaacttttaagactcttcattaattggagcttctgggcaacatcgtgtgtgtgtgtgtgtgtgtgtgtgtgtgtgtgtgtatacagacattttttttttaacttgttgattcagatgtcttggtccctgaatagtcctagattacttattttgagaattcattgttaaaaattacagggaattaaaataattgcctttttttttttagagggtaagagatgggtagaagagtatgcctctgaaaattttattagtttattcttgtggagaataccaagaaaatgtgtatttgcccattgctaaatatgatatatgccattttgtatttatttgtcccaagtgtctttttgtaagaggagaataaacaataaggaattactgatcaaaaaaaac

SEQ ID NO: 319435 - DNA, 4582 bp, Homo sapiens
gagcgggagtccgcggccgccgctgccgggcccggagtccgcggcgccccgaaggtaatcattaccaaatgaggaggaaaggacgatgtcatcgaggctctgcagcgaggcatccttcttccccatgcagtgttaaacactcccctacgcgagaaacgctgacctacgctcaagctcaaaggatggtagagatagaaattgaagggcgcttgcacaggatcagtatttttgatcccctggagatcatattggaagatgacctcactgctcaagagatgagtgagtgcaacagcaacaaggaaaacagcgagcggcctcctgtctgcttaagaactaagcgtcacaaaaacaacagagtcaaaaagaaaaacgaggccctccccagcgcccacggcacgccggcctcggccagtgccctcccggagcccaaggtgcgcatcgtggagtacagccctccgtccgcccccaggaggcctcctgtgtactacaagttcatcgagaagtcggccgaggaactggacaacgaggtggagtatgacatggacgaggaggactatgcctggctggagatcgtcaatgagaagcgcaagggcgactgcgtccccgccgtgtcgcagagcatgtttgagttcctgatggaccgcttcgagaaggagtcgcactgcgagaaccagaagcagggcgagcagcagtctctgatcgacgaggacgccgtgtgctgcatctgcatggacggggagtgtcagaacagcaacgtgatcctcttctgcgacatgtgcaacctggccgtgcaccaggagtgctacggggtgccctacatccccgagggccagtggctctgccgccactgcctgcagtcgcgggcccggcccgccgactgtgtgctgtgccccaacaagggtggtgccttcaaaaagacagatgacgaccgctggggtcacgtggtgtgtgccctgtggatcccagaggtcggctttgccaacacggtgttcatcgagcccatcgatggggtgaggaacatccctccagcccggtggaaactgacatgctacctctgtaagcagaagggcgtgggtgcctgcatccagtgccacaaagcaaactgctacacagcattccatgtgacgtgtgcccagaaggctggcctgtacatgaaaatggagcccgtgaaggaactgactggcggtggcaccaccttctccgtcagaaagaccgcttactgtgatgtccacacgcctccaggctgcacccggaggcctctgaatatttacggggatgtcgaaatgaaaaatggcgtctgtcgaaaagagagctcggttaaaacggtcaggtccacatccaaggtcaggaagaaggcaaaaaaggctaagaaagctctggctgagccctgcgcggtcctgccgaccgtgtgcgctccttatattcccccgcagaggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacgtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaaggagataaatctccccctaaacttgaaccatcagatgcattacctcttccttcaaactcggagactaattcagaaccaccaaccctcaaaccagtagaactcaacccagagcagagtaaacttttcaaaagagtcacatttgataatgaatcacatagcgcttgcactcagagcgcactggtaagcggacgccctccagagcccacccgcgccagtagtggcgatgtgccggcggcggcggcctccgcggtggcggagccagcaagcgatgtaaacagacgcacttctgttctcttctgcaaatcgaaaagtgtaagccccccaaagtctgccaagaacactgaaacccagccaacttctcctcagctagggaccaaaacctttttgtctgtagtccttccgaggttggagactcttctgcagccaaggaaaaggtcgcggagcacatgcggagactccgaggtggaggaggagtccccaggaaagcgcctggacgcaggtctcaccaacggctttgggggtgcgaggagcgagcaggagccgggcggcggcctggggaggaaggccacaccccgacgacgctgtgcctccgagtccagcatctcctccagcaacagcccgctctgcgactcgagctttaatgcgcccaaatgtgggcggggcaaaccggctcttgtgcgacggcacacgctggaggaccgcagtgagctgatctcctgcatcgagaatgggaactacgccaaggcggccaggatcgcagccgaagtcggccagagcagcatgtggatctccactgatgccgccgcctcggtgctggagcctctgaaggtggtgtgggccaagtgcagcggctacccctcctacccggcactgatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttgttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtcaaga

SEQ ID NO: 319436 - DNA, 3172 bp, Homo sapiens
gatacactgagtgtttgtgttttaggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacgtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaaggagataaatctccccctaaacttgaaccatcagatgcattacctcttccttcaaactcggagactaattcagaaccaccaaccctcaaaccagtagaactcaacccagagcagagtaaacttttcaaaagagtcacatttgataatgaatcacatagcgcttgcactcagagcgcactggtaagcggacgccctccagagcccacccgcgccagtagtggcgatgtgccggcggcggcggcctccgcggtggcggagccagcaagcgatgtaaacagacgcacttctgttctcttctgcaaatcgaaaagtgtaagccccccaaagtctgccaagaacactgaaacccagccaacttctcctcagctagggaccaaaacctttttgtctgtagtccttccgaggttggagactcttctgcagccaaggaaaaggtcgcggagcacatgcggagactccgaggtggaggaggagtccccaggaaagcgcctggacgcaggtctcaccaacggctttgggggtgcgaggagcgagcaggagccgggcggcggcctggggaggaaggccacaccccgacgacgctgtgcctccgagtccagcatctcctccagcaacagcccgctctgcgactcgagctttaatgcgcccaaatgtgggcggggcaaaccggctcttgtgcgacggcacacgctggaggaccgcagtgagctgatctcctgcatcgagaatgggaactacgccaaggcggccaggatcgcagccgaagtcggccagagcagcatgtggatctccactgatgccgccgcctcggtgctggagcctctgaaggtggtgtgggccaagtgcagcggctacccctcctacccggcactgatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttgttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtcaaga

SEQ ID NO: 319437 - DNA, 287 bp, Homo sapiens
agtgacgtgtttaatattggcgcatgtgaaataatctttcacagtttttttcagagagtaactgtgtgcctgggcactgcacccagggccgcagcctttggcgttagggaagcacacacagtgtggcccgagcccacggggcccacactgccgagcagacagtacatgcgatgccttgtttccttaactgaattagtattttggtggacttcacatttatagtaagttttataatagattttataatcttcagttttcaaaaatcactttatttataattttttcag

SEQ ID NO: 319438 - DNA, 403 bp, Homo sapiens
ggggaggggaagggaggggtgcactcctggcctcgggcctgtccctgcacggggcccagctgtcttggtggtgctgagcagggcccctttctatcggagggcagtgaatttgttagatgattacatggagcctgctgaaataccatgtgcaagcaatgattttccgcttgtttttccttttaaaaaggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccata

SEQ ID NO: 319439 - DNA, 946 bp, Homo sapiens
agcttcatggtgagtgaggccagacacactcagacacggcgatggccccggattttgtgttttaaagtgtttcgtcagcatttttgacttcatgttaacacttgtcttttgaaccaaggttttttctttttaaaacctgatttcctattccctggagctctgctcctgtgaacatgtttttgtgtctttggtggccccttcggcctggtgaagtttccgttcaaacgcggccggtgcccacgtggacaggccgcccccgtgtttgcactcacaggttgcacatctgcccccatggcaggctcacggcatcctttctttgccttcacagagcctgtctaaagacccgggcttgtcaagaggagcatcttcatggtgctcagcaaactactacgatcggagccgactgcagtttgttaagttgatttcatttaacgagtaactttggtgtctgcttactgtaaggactatgctcgggaacttgggagtgaaaaggaagatgctgtcttacctgtctgtgaaacgtgctttgtaagatgtgttccaagtgtaacgtcgttgagtcatgcttcagtgtgccctggttgtgctgagctcagggcctgcccgcctgtgttccaggtctcaccaacggctttgggggtgcgaggagcgagcaggagccgggcggcggcctggggaggaaggccacaccccgacgacgctgtgcctccgagtccagcatctcctccagcaacagcccgctctgcgactcgaggtgggcaccgcggccctgcgcttcccaccacgcagctcccagcaccgcccgccccgcctggctgtcctggaagccgggacattccagctcccatcttagtgttctctgaaaaattctggcctgggattcatgtgtgctctgcccttgtggacagtttcccatgctgcatattaatctgctttatagaattca

SEQ ID NO: 319440 - DNA, 4608 bp, Homo sapiens
atccgataggaccaggtagccactgagcatgcctgtctggtgggcatagcctctgtgcctggtggggtccagccctgtatgtggacttcctgggggaccgcctgcatgctgggaaagtcctgcaactgtgggctctgggccggacccctcctccttggggagcgttgctgtggtctccgcagcctgttggtgtggtccgagaggggactggtgtgtggtggtagggacgcaggtgctcaggagggctcctcaggctgcctctctgcctgttactgctgctccctccctggtcctggggactcgctcaggcctggatgtgtggttttggacaccttggaaagaggttagctgtgagttttgctttgattgggctttgagctgctgagctagatctgtccaagcatgcttttgtggttttctcgagtctttggtcaccctgcgtagaattacctttacttttgccttcattttaggtaatcattaccaaatgaggaggaaaggacgatgtcatcgaggctctgcagcgaggcatccttcttccccatgcagtgttaaacactcccctacgcgagaaacgctgacctacgctcaagctcaaaggatggtagagatagaaattgaagggcgcttgcacaggatcagtatttttgatcccctggagatcatattggaagatgacctcactgctcaagagatgagtgagtgcaacagcaacaaggaaaacagcgagcggcctcctgtctgcttaagaactaagcgtcacaaaaacaacagagtcaaaaagaaaaacgaggccctccccagcgcccacggcacgccggcctcggccagtgccctcccggagcccaaggtgcgcatcgtggagtacagccctccgtccgcccccaggaggcctcctgtgtactacaagttcatcgagaagtcggccgaggaactggacaacgaggtggagtatgacatggacgaggaggactatgcctggctggagatcgtcaatgagaagcgcaagggcgactgcgtccccgccgtgtcgcagagcatgtttgagttcctgatggaccgcttcgagaaggagtcgcactgcgagaaccagaagcagggcgagcagcagtctctgatcgacgaggacgccgtgtgctgcatctgcatggacggggagtgtcagaacagcaacgtgatcctcttctgcgacatgtgcaacctggccgtgcaccaggagtgctacggggtgccctacatccccgagggccagtggctctgccgccactgcctgcagtcgcgggcccggcccgccgactgtgtgctgtgccccaacaagggtggtgccttcaaaaagacagatgacgaccgctggggtcacgtggtgtgtgccctgtggatcccagaggtcggctttgccaacacggtgttcatcgagcccatcgatggggtgaggaacatccctccagcccggtggaaactgacatgctacctctgtaagcagaagggcgtgggtgcctgcatccagtgccacaaagcaaactgctacacagcattccatgtgacgtgtgcccagaaggctggcctgtacatgaaaatggagcccgtgaaggaactgactggcggtggcaccaccttctccgtcagaaagaccgcttactgtgatgtccacacgcctccaggctgcacccggaggcctctgaatatttacggggatgtcgaaatgaaaaatggcgtctgtcgaaaagagagctcggttaaaacggtcaggtccacatccaaggtcaggaagaaggcaaaaaaggctaagaaagctctggctgagccctgcgcggtcctgccgaccgtgtgcgctccttatattcccccgcagaggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacgtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaagtccttccgaggttggagactcttctgcagccaaggaaaaggtcgcggagcacatgcggagactccgaggtggaggaggagtccccaggaaagcgcctggacgcaggtctcaccaacggctttgggggtgcgaggagcgagcaggagccgggcggcggcctggggaggaaggccacaccccgacgacgctgtgcctccgagtccagcatctcctccagcaacagcccgctctgcgactcgagctttaatgcgcccaaatgtgggcggggcaaaccggctcttgtgcgacggcacacgctggaggaccgcagtgagctgatctcctgcatcgagaatgggaactacgccaaggcggccaggatcgcagccgaagtcggccagagcagcatgtggatctccactgatgccgccgcctcggtgctggagcctctgaaggtggtgtgggccaagtgcagcggctacccctcctacccggcactgatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttgttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtcaaga

SEQ ID NO: 319441 - DNA, 4699 bp, Homo sapiens
caatctagtttcaacatacaatgaggatttctgtctgatacagagaaagatacccagtgtctggagggtctgtcttaagaagtgctcttgaagtctgctgggatttcctttcgggactcacagagggaagcctgctccctgagggctttttctcaggcccaatagatcagggtaatcattaccaaatgaggaggaaaggacgatgtcatcgaggctctgcagcgaggcatccttcttccccatgcagtgttaaacactcccctacgcgagaaacgctgacctacgctcaagctcaaaggatggtagagatagaaattgaagggcgcttgcacaggatcagtatttttgatcccctggagatcatattggaagatgacctcactgctcaagagatgagtgagtgcaacagcaacaaggaaaacagcgagcggcctcctgtctgcttaagaactaagcgtcacaaaaacaacagagtcaaaaagaaaaacgaggccctccccagcgcccacggcacgccggcctcggccagtgccctcccggagcccaaggtgcgcatcgtggagtacagccctccgtccgcccccaggaggcctcctgtgtactacaagttcatcgagaagtcggccgaggaactggacaacgaggtggagtatgacatggacgaggaggactatgcctggctggagatcgtcaatgagaagcgcaagggcgactgcgtccccgccgtgtcgcagagcatgtttgagttcctgatggaccgcttcgagaaggagtcgcactgcgagaaccagaagcagggcgagcagcagtctctgatcgacgaggacgccgtgtgctgcatctgcatggacggggagtgtcagaacagcaacgtgatcctcttctgcgacatgtgcaacctggccgtgcaccaggagtgctacggggtgccctacatccccgagggccagtggctctgccgccactgcctgcagtcgcgggcccggcccgccgactgtgtgctgtgccccaacaagggtggtgccttcaaaaagacagatgacgaccgctggggtcacgtggtgtgtgccctgtggatcccagaggtcggctttgccaacacggtgttcatcgagcccatcgatggggtgaggaacatccctccagcccggtggaaactgacatgctacctctgtaagcagaagggcgtgggtgcctgcatccagtgccacaaagcaaactgctacacagcattccatgtgacgtgtgcccagaaggctggcctgtacatgaaaatggagcccgtgaaggaactgactggcggtggcaccaccttctccgtcagaaagaccgcttactgtgatgtccacacgcctccaggctgcacccggaggcctctgaatatttacggggatgtcgaaatgaaaaatggcgtctgtcgaaaagagagctcggttaaaacggtcaggtccacatccaaggtcaggaagaaggcaaaaaaggctaagaaagctctggctgagccctgcgcggtcctgccgaccgtgtgcgctccttatattcccccgcagaggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacgtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaaggagataaatctccccctaaacttgaaccatcagatgcattacctcttccttcaaactcggagactaattcagaaccaccaaccctcaaaccagtagaactcaacccagagcagagtaaacttttcaaaagagtcacatttgataatgaatcacatagcgcttgcactcagagcgcactggtaagcggacgccctccagagcccacccgcgccagtagtggcgatgtgccggcggcggcggcctccgcggtggcggagccagcaagcgatgtaaacagacgcacttctgttctcttctgcaaatcgaaaagtgtaagccccccaaagtctgccaagaacactgaaacccagccaacttctcctcagctagggaccaaaacctttttgtctgtagtccttccgaggttggagactcttctgcagccaaggaaaaggtcgcggagcacatgcggagactccgaggtggaggaggagtccccaggaaagcgcctggacgcaggtctcaccaacggctttgggggtgcgaggagcgagcaggagccgggcggcggcctggggaggaaggccacaccccgacgacgctgtgcctccgagtccagcatctcctccagcaacagcccgctctgcgactcgagctttaatgcgcccaaatgtgggcggggcaaaccggctcttgtgcgacggcacacgctggaggaccgcagtgagctgatctcctgcatcgagaatgggaactacgccaaggcggccaggatcgcagccgaagtcggccagagcagcatgtggatctccactgatgccgccgcctcggtgctggagcctctgaaggtggtgtgggccaagtgcagcggctacccctcctacccggcactgatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttgttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtcaaga

SEQ ID NO: 319442 - DNA, 3554 bp, Homo sapiens
gagcgggagtccgcggccgccgctgccgggcccggagtccgcggcgccccgaaggtaatcattaccaaatgaggaggaaaggacgatgtcatcgaggctctgcagcgaggcatccttcttccccatgcagtgttaaacactcccctacgcgagaaacgctgacctacgctcaagctcaaaggatggtagagatagaaattgaagggcgcttgcacaggatcagtatttttgatcccctggagatcatattggaagatgacctcactgctcaagagatgagtgagtgcaacagcaacaaggaaaacagcgagcggcctcctgtctgcttaagaactaagcgtcacaaaaacaacagagtcaaaaagaaaaacgaggccctccccagcgcccacggcacgccggcctcggccagtgccctcccggagcccaaggtgcgcatcgtggagtacagccctccgtccgcccccaggaggcctcctgtgtactacaagttcatcgagaagtcggccgaggaactggacaacgaggtggagtatgacatggacgaggaggactatgcctggctggagatcgtcaatgagaagcgcaagggcgactgcgtccccgccgtgtcgcagagcatgtttgagttcctgatggaccgcttcgagaaggagtcgcactgcgagaaccagaagcagggcgagcagcagtctctgatcgacgaggacgccgtgtgctgcatctgcatggacggggagtgtcagaacagcaacgtgatcctcttctgcgacatgtgcaacctggccgtgcaccaggagtgctacggggtgccctacatccccgagggccagtggctctgccgccactgcctgcagtcgcgggcccggcccgccgactgtgtgctgtgccccaacaagggtggtgccttcaaaaagacagatgacgaccgctggggtcacgtggtgtgtgccctgtggatcccagaggtcggctttgccaacacggtgttcatcgagcccatcgatggggtgaggaacatccctccagcccggtggaaactgacatgctacctctgtaagcagaagggcgtgggtgcctgcatccagtgccacaaagcaaactgctacacagcattccatgtgacgtgtgcccagaaggctggcctgtacatgaaaatggagcccgtgaaggaactgactggcggtggcaccaccttctccgtcagaaagaccgcttactgtgatgtccacacgcctccaggctgcacccggaggcctctgaatatttacggggatgtcgaaatgaaaaatggcgtctgtcgaaaagagagctcggttaaaacggtcaggtccacatccaaggtcaggaagaaggcaaaaaaggctaagaaagctctggctgagccctgcgcggtcctgccgaccgtgtgcgctccttatattcccccgcagaggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacgtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaaggagataaatctccccctaaacttgaaccatcagatgcattacctcttccttcaaactcggagactaattcagaaccaccaaccctcaaaccagtagaactcaacccagagcagagtaaacttttcaaaagagtcacatttgataatgaatcacatagcgcttgcactcagagcgcactggtaagcggacgccctccagagcccacccgcgccagtagtggcgatgtgccggcggcggcggcctccgcggtggcggagccagcaagcgatgtaaacagacgcacttctgttctcttctgcaaatcgaaaagtgtaagccccccaaagtctgccaagaacactgaaacccagccaacttctcctcagctagggaccaaaacctttttgtctgtagtccttccgaggttggagactcttctgcagccaaggaaaaggtcgcggagcacatgcggagactccgaggtggaggaggagtccccaggaaagcgcctggacgcaggtctcaccaacggctttgggggtgcgaggagcgagcaggagccgggcggcggcctggggaggaaggccacaccccgacgacgctgtgcctccgagtccagcatctcctccagcaacagcccgctctgcgactcgagctttaatgcgcccaaatgtgggcggggcaaaccggctcttgtgcgacggcacacgctggaggaccgcagtgagctgatctcctgcatcgagaatgggaactacgccaaggcggccaggatcgcagccgaagtcggccagagcagcatgtggatctccactgatgccgccgcctcggtgctggagcctctgaaggtggtgtgggccaagtgcagcggctacccctcctacccggcactgatcatcgaccccaagatgccccgtgtgcctggccaccacaaaagcgatccgcacggccttccggatgctggaattcctcccttccatcatctttaacttgtctatagtttcgtcaataccaaggggaaccattttggacttaggaagccactgccaacttctcttattatcaaaaaagagaacgaggaacagcttctcatcagacttggtctgcatgtgctccccaatcttcagcacgtccaggggtggggccgg

SEQ ID NO: 319443 - DNA, 790 bp, Homo sapiens
atttgtagactttccatctttaataacattttattgtgtaaataaaagcttgacatacactttttaaaacaaacttgtacattagaattcattttacttgtgatttacacattaatacatattttaaacctaggtgccacagaaacagaagaacaggtttggaatacaatttaatatattttaaaatgagttacatatattttaaaaacatgagccgttttgttatttgacagttctagttactttaatagtttctatggtaacatgcatttaaatctgtaaacacctggtacgttcacagtatttggtttgataaactaattagtaaaaactgtattcaatcaattgataaattaactttttcttttatattacaggaaaacaaccaaagttttaagtagcattttaagaacagatgaatttaagtttggacatctgcaaatgaggtggatctagcaacaataactgtaatggactgtgacaattcaatttattcttaattttgatggttggctatttgacttctctaaaaatgagaaagagctattttaaaatataaagaattttctaatcagtttcagctttgcaggaggtttcctgcataaattgggaagtaacactggaaagtaggaatttggttagtgaagtgggaagactgtatatttataatttgcatactacttgcaattttttgtttttcatcacttgtaataatggaatggaaatgtaagctgtaaagactctcaaatataaaatatttgctacagtgtatatatggtacataattgct

SEQ ID NO: 319444 - DNA, 2658 bp, Homo sapiens
atttgtagactttccatctttaataacattttattgtgtaaataaaagcttgacatacactttttaaaacaaacttgtacattagaattcattttacttgtgatttacacattaatacatattttaaacctaggtgccacagaaacagaagaacaggtttggaatacaatttaatatattttaaaatgagttacatatattttaaaaacatgagccgttttgttatttgacagttctagttactttaatagtttctatggtaacatgcatttaaatctgtaaacacctggtacgttcacagtatttggtttgataaactaattagtaaaaactgtattcaatcaattgataaattaactttttcttttatattacaggaaaacaaccaaagttttaagtagcattttaagaacagatgaatttaagtttggacatctgcaaatgaggtggatctagcaacaataactgtaatggactgtgacaattcaatttattcttaattttgatggttggctatttgacttctctaaaaatgagaaagagctattttaaaatataaagaattttctaatcagtttcagctttgcaggaggtttcctgcataaattgggaagtaacactggaaagtaggaatttggttagtgaagtgggaagactgtatatttataatttgcatactacttgcaattttttgtttttcatcacttgtaataatggaatggaaatgtaagctgtaaagactctcaaatataaaatatttgctacagtgtatatatggtacataattgcttgttgcttttaaagttccttctgttgttctgcttcccactgatttcataccagctcatgaatggatcattacagtctctccagaggcttagaatgattcagaatgttcaatgcatagttctcaataaacaggaggcagaatttttaatgggtatttcttttcagatatatgattggtctctaggtttttgataataatatggtcttaaattcataattactagcagagattgataatttggaaacaatggtagtgaatgaaactgaagttgaaaaacggctgctacttatgtcactaatcagaccatatgaatagcagaagttgagcaatttcaaagtaaaactgatatttttatttccaaaggaatttagacatttgaaaataattgacatacattaagttttaattcgataatttcttatatatggatgaacaatttttgggtttaagcttttaattcctagaaattttatacattaaatctcctgcaatttgtcactctggatgttactgtttaaaaaaaaaaaaaaaaaggggtttcttccagaaaaatctgctgatatataggtaagtaagtgtaaactctccctaattctatttcttagatccctaggtctattggcacaaaagtttgtttcactgaattttgaactcctaaaccagtacttttttgtttcactgttttttgagcttgtttccccagattcaagcttgtattccatgttacgtttcccatcttggtcttttagtgacctcttttttttattttttaattttttaaattttttttttattttactactttgttctttaggaaaatggggttttaaatagaaaaaaatcttcgttaactataaacttattgtttactttaggatgagatatttatacttaggtcccagttttttctttttttttcttttttctttttctttttctttttttttttggccctactagtttccttttctactataggttccagtatatatgtgtatgtgaatacacactcacacacattcacatacatacaactctcacaaacatacacaaaaatacatgtataatttgtataagagctggggtcagaatgaccatataattatattggtttgctttgttatttgcccgttctcaagtcattctaattcttgtttcagaatatgatagagcttattccaatttggaatctgcagatcccttccacttagtactgttaatgaaaacagaacccttttaacaagtaatactaccatgctactttggaaactgcctagtacccaaaatatttgatatgctttttgagttggatacttaaatgcaccaaccaaagcaatgttttgattggctataatttgtatttttgaaaccatttacaacaaacattctcaagaagagtttgtatgtcaaaagtcatttaggttttaaagtcttttgatcttttcttactatatacaatcagtctgcagagactgttatgtgtctgtttgcctttgtacatatatatagcttgtttgaataatcattgtgcatctccattaatgttgttctttgctttgtatataaattaaaagagttgacccaggtgttgttacacagtgtctgtcatccttagagttgaccagaggcacacaaaacacacacacacacacacacacacacacacacacacacacgtgtgtatgtacaatatatcaaaatttactacttatttctaatagaactatgaaaggattttaaaattttatttatactgaatgagaactgagagtatacaaaggtattggtaaaagttgctgtttcatgaattagtttgagaaaatattttaggtcaaatttatatttaagaaataaaattttattagttc

SEQ ID NO: 319445 - DNA, 2781 bp, Homo sapiens
ctcgccccccgccgccgccaccgcggtcagccagcggaccagcggcaggagccgttccccgacgggcagcagggcgctcggcctccgcgtgtgggctgagcgcggcgacgctgctgccccgaaatccccgtggattttgagtcgtatggaacctcaaagtctttgtgacaatggaaaccaaaaaattaattggtaaaccgcttcaaccagcaagacctgttcgtcatctgacttctcccccaggagcagtgttccctttcaactttcaaaacgaatatccatgcaacactcagtgcatacaaagtggagttagcagatgtaagacgaatggaatgcaagccttttctcaaggtcttaatgagcaacagcaacagcagtctccagttaagaaagagagaattaaatacagcagagatttcctgttgaagctctcaagtgtttccatctgcagaaaaaaaccagactttctgcctgatcatcccattgtactgcaaaaaccagaaaacaaccaaagttttaagtagcattttaagaacagatgaatttaagtttggacatctgcaaatgaggtggatctagcaacaataactgtaatggactgtgacaattcaatttattcttaattttgatggttggctatttgacttctctaaaaatgagaaagagctattttaaaatataaagaattttctaatcagtttcagctttgcaggaggtttcctgcataaattgggaagtaacactggaaagtaggaatttggttagtgaagtgggaagactgtatatttataatttgcatactacttgcaattttttgtttttcatcacttgtaataatggaatggaaatgtaagctgtaaagactctcaaatataaaatatttgctacagtgtatatatggtacataattgcttgttgcttttaaagttccttctgttgttctgcttcccactgatttcataccagctcatgaatggatcattacagtctctccagaggcttagaatgattcagaatgttcaatgcatagttctcaataaacaggaggcagaatttttaatgggtatttcttttcagatatatgattggtctctaggtttttgataataatatggtcttaaattcataattactagcagagattgataatttggaaacaatggtagtgaatgaaactgaagttgaaaaacggctgctacttatgtcactaatcagaccatatgaatagcagaagttgagcaatttcaaagtaaaactgatatttttatttccaaaggaatttagacatttgaaaataattgacatacattaagttttaattcgataatttcttatatatggatgaacaatttttgggtttaagcttttaattcctagaaattttatacattaaatctcctgcaatttgtcactctggatgttactgtttaaaaaaaaaaaaaaaaaggggtttcttccagaaaaatctgctgatatataggtaagtaagtgtaaactctccctaattctatttcttagatccctaggtctattggcacaaaagtttgtttcactgaattttgaactcctaaaccagtacttttttgtttcactgttttttgagcttgtttccccagattcaagcttgtattccatgttacgtttcccatcttggtcttttagtgacctcttttttttattttttaattttttaaattttttttttattttactactttgttctttaggaaaatggggttttaaatagaaaaaaatcttcgttaactataaacttattgtttactttaggatgagatatttatacttaggtcccagttttttctttttttttcttttttctttttctttttctttttttttttggccctactagtttccttttctactataggttccagtatatatgtgtatgtgaatacacactcacacacattcacatacatacaactctcacaaacatacacaaaaatacatgtataatttgtataagagctggggtcagaatgaccatataattatattggtttgctttgttatttgcccgttctcaagtcattctaattcttgtttcagaatatgatagagcttattccaatttggaatctgcagatcccttccacttagtactgttaatgaaaacagaacccttttaacaagtaatactaccatgctactttggaaactgcctagtacccaaaatatttgatatgctttttgagttggatacttaaatgcaccaaccaaagcaatgttttgattggctataatttgtatttttgaaaccatttacaacaaacattctcaagaagagtttgtatgtcaaaagtcatttaggttttaaagtcttttgatcttttcttactatatacaatcagtctgcagagactgttatgtgtctgtttgcctttgtacatatatatagcttgtttgaataatcattgtgcatctccattaatgttgttctttgctttgtatataaattaaaagagttgacccaggtgttgttacacagtgtctgtcatccttagagttgaccagaggcacacaaaacacacacacacacacacacacacacacacacacacacacgtgtgtatgtacaatatatcaaaatttactacttatttctaatagaactatgaaaggattttaaaattttatttatactgaatgagaactgagagtatacaaaggtattggtaaaagttgctgtttcatgaattagtttgagaaaatattttaggtcaaatttatatttaagaaataaaattttattagttc

SEQ ID NO: 319446 - DNA, 913 bp, Homo sapiens
ctcgccccccgccgccgccaccgcggtcagccagcggaccagcggcaggagccgttccccgacgggcagcagggcgctcggcctccgcgtgtgggctgagcgcggcgacgctgctgccccgaaatccccgtggattttgagtcgtatggaacctcaaagtctttgtgacaatggaaaccaaaaaattaattggtaaaccgcttcaaccagcaagacctgttcgtcatctgacttctcccccaggagcagtgttccctttcaactttcaaaacgaatatccatgcaacactcagtgcatacaaagtggagttagcagatgtaagacgaatggaatgcaagccttttctcaaggtcttaatgagcaacagcaacagcagtctccagttaagaaagagagaattaaatacagcagagatttcctgttgaagctctcaagtgtttccatctgcagaaaaaaaccagactttctgcctgatcatcccattgtactgcaaaaaccagaaaacaaccaaagttttaagtagcattttaagaacagatgaatttaagtttggacatctgcaaatgaggtggatctagcaacaataactgtaatggactgtgacaattcaatttattcttaattttgatggttggctatttgacttctctaaaaatgagaaagagctattttaaaatataaagaattttctaatcagtttcagctttgcaggaggtttcctgcataaattgggaagtaacactggaaagtaggaatttggttagtgaagtgggaagactgtatatttataatttgcatactacttgcaattttttgtttttcatcacttgtaataatggaatggaaatgtaagctgtaaagactctcaaatataaaatatttgctacagtgtatatatggtacataattgct

SEQ ID NO: 319447 - DNA, 950 bp, Homo sapiens
  misc_feature (914)..(914): n is a, c, g, or t
  misc_feature (917)..(917): n is a, c, g, or t
  misc_feature (932)..(932): n is a, c, g, or t
  misc_feature (934)..(934): n is a, c, g, or t
  misc_feature (942)..(942): n is a, c, g, or t
ctcgccccccgccgccgccaccgcggtcagccagcggaccagcggcaggagccgttccccgacgggcagcagggcgctcggcctccgcgtgtgggctgagcgcggcgacgctgctgccccgaaatccccgtggattttgagtcgtatggaacctcaaagtctttgtgacaatggaaaccaaaaaattaattggtaaaccgcttcaaccagcaagacctgttcgtcatctgacttctcccccaggagcagtgttccctttcaactttcaaaacgaatatccatgcaacactcagtgcatacaaagtggagttagcagatgtaagacgaatggaatgcaagccttttctcaaggtcttaatgagcaacagcaacagcagtctccagttaagaaagagagaattaaatacagcagagatttcctgttgaagctctcaagtgtttccatctgcagaaaaaaaccagactttctgcctgatcatcccattgtactgcaaaaaccagaaaacaaccaaagttttaagtagcattttaagaacagatgaatttaagtttggacatctgcaaatgaggtggatctagcaacaataactgtaatggactgtgacaattcaatttattcttaattttgatggttggctatttgacttctctaaaaatgagaaagagctattttaaaatataaagaattttctaatcagtttcagctttgcaggaggtttcctgcataaattgggaagtaacactggaaagtaggaatttggttagtgaagtgggaagactgtatatttataatttgcatactacttgcaattttttgtttttcatcacttgtaataatggaatggaaatgtaagctgtaaagactctcaaatataaaatatttgctacagtgtatatatggtacataattgctnctngctaccccgggtacnanctcgagtntatatgta

SEQ ID NO: 319448 - DNA, 2851 bp, Homo sapiens
ctcgccccccgccgccgccaccgcggtcagccagcggaccagcggcaggagccgttccccgacgggcagcagggcgctcggcctccgcgtgtgggctgagcgcggcgacgctgctgccccgaaatccccgtggattttgagtcgtatggaacctcaaagtctttgtgacaatggaaaccaaaaaattaattggtaaaccgcttcaaccagcaagacctgttcgtcatctgacttctcccccaggagcagtgttccctttcaactttcaaaacgaatatccatgcaacactcagtgcatacaaagtggagttagcagaacagaatggaaatgcaagaacattttcatcaaaggtcattaaatgaggaaaaaacgaaacagaagatatcaaagattaaagaaaagaagagaaattaaaaataacagaaagaagaattatcatgttgaaagacatcatcaaagtgttatcacatcattggaagaagagaaaaaaacagagtacattatatgacatggatcaatacccagttgttaatggaaaaaaacacaagaaaaaacaaaccacaagattattaaagattagaattatataaagaaacaagaatcgaaattttaaagattatgggaccgtcctggcacatgaaggtctagcaacaataactgtaatggactgtgacaattcaatttattcttaattttgatggttggctatttgacttctctaaaaatgagaaagagctattttaaaatataaagaattttctaatcagtttcagctttgcaggaggtttcctgcataaattgggaagtaacactggaaagtaggaatttggttagtgaagtgggaagactgtatatttataatttgcatactacttgcaattttttgtttttcatcacttgtaataatggaatggaaatgtaagctgtaaagactctcaaatataaaatatttgctacagtgtatatatggtacataattgcttgttgcttttaaagttccttctgttgttctgcttcccactgatttcataccagctcatgaatggatcattacagtctctccagaggcttagaatgattcagaatgttcaatgcatagttctcaataaacaggaggcagaatttttaatgggtatttcttttcagatatatgattggtctctaggtttttgataataatatggtcttaaattcataattactagcagagattgataatttggaaacaatggtagtgaatgaaactgaagttgaaaaacggctgctacttatgtcactaatcagaccatatgaatagcagaagttgagcaatttcaaagtaaaactgatatttttatttccaaaggaatttagacatttgaaaataattgacatacattaagttttaattcgataatttcttatatatggatgaacaatttttgggtttaagcttttaattcctagaaattttatacattaaatctcctgcaatttgtcactctggatgttactgtttaaaaaaaaaaaaaaaaaggggtttcttccagaaaaatctgctgatatataggtaagtaagtgtaaactctccctaattctatttcttagatccctaggtctattggcacaaaagtttgtttcactgaattttgaactcctaaaccagtacttttttgtttcactgttttttgagcttgtttccccagattcaagcttgtattccatgttacgtttcccatcttggtcttttagtgacctcttttttttattttttaattttttaaattttttttttattttactactttgttctttaggaaaatggggttttaaatagaaaaaaatcttcgttaactataaacttattgtttactttaggatgagatatttatacttaggtcccagttttttctttttttttcttttttctttttctttttctttttttttttggccctactagtttccttttctactataggttccagtatatatgtgtatgtgaatacacactcacacacattcacatacatacaactctcacaaacatacacaaaaatacatgtataatttgtataagagctggggtcagaatgaccatataattatattggtttgctttgttatttgcccgttctcaagtcattctaattcttgtttcagaatatgatagagcttattccaatttggaatctgcagatcccttccacttagtactgttaatgaaaacagaacccttttaacaagtaatactaccatgctactttggaaactgcctagtacccaaaatatttgatatgctttttgagttggatacttaaatgcaccaaccaaagcaatgttttgattggctataatttgtatttttgaaaccatttacaacaaacattctcaagaagagtttgtatgtcaaaagtcatttaggttttaaagtcttttgatcttttcttactatatacaatcagtctgcagagactgttatgtgtctgtttgcctttgtacatatatatagcttgtttgaataatcattgtgcatctccattaatgttgttctttgctttgtatataaattaaaagagttgacccaggtgttgttacacagtgtctgtcatccttagagttgaccagaggcacacaaaacacacacacacacacacacacacacacacacacacacacgtgtgtatgtacaatatatcaaaatttactacttatttctaatagaactatgaaaggattttaaaattttatttatactgaatgagaactgagagtatacaaaggtattggtaaaagttgctgtttcatgaattagtttgagaaaatattttaggtcaaatttatatttaagaaataaaattttattagttc

SEQ ID NO: 319449 - DNA, 557 bp, Homo sapiens
gcataggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataaaaaaaaa

SEQ ID NO: 319450 - DNA, 821 bp, Homo sapiens
  misc_feature (699)..(699): n is a, c, g, or t
gcataggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataaaaaaaaagaatcggggattagtcggggggcggacaaaagcgtgtgttatgaaggcgccaggctcatatgtgtcttcctgacccagctttcttggacacagggtgagaatccgcgggccccaatgtgagagccgaataaattcagaaagnccaggttagccggtaagaatacgcgcaaaaaagaacccaagtttgtgtcacacacatccattatagaaccacgtttaccggaataaaaaatagtgtgcgagctttacacaggagacaaccat

SEQ ID NO: 319451 - DNA, 591 bp, Homo sapiens
ggccagacattcggttctgggaagctacatgcatccactggttggagctccatgtccccgggcctcgtggttttgcgatgggctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataaaaaaaaa

SEQ ID NO: 319452 - DNA, 696 bp, Homo sapiens
ttttttttatggggaaaagatatatatatatatatattcagaattaggcagctggactcagtttagatgatcccaattttgttggcaacatccaaagcatcgtaatcaggagccagtcgaacatatgccttcttctctccatcaggccgaatcagggtgttgaccttggccacatcaatgtcatacagcttcttcacagcctgtttaatctggtgcttgttggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataaaaaaaaa

SEQ ID NO: 319453 - DNA, 764 bp, Homo sapiens
  misc_feature (577)..(577): n is a, c, g, or t
  misc_feature (584)..(584): n is a, c, g, or t
  misc_feature (590)..(590): n is a, c, g, or t
  misc_feature (592)..(592): n is a, c, g, or t
gcataggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataaaaaaaaatacatgcctgtctgtcaatntctggtngggctngngaggccacacacacacactgatatgacagggtcgggacaagactcctgttcatacttactcacttgtcgaaaaaacctcaacctgacaatccaaccatgtatgatcatcccagacgatctcgcgactagagctcagtgtcctaggaaaaaccaaaactacagaactgcatcg

SEQ ID NO: 319454 - DNA, 768 bp, Homo sapiens
ggccagacattcggttctgggaagctacatgcatccactggttggagctccatgtccccgggcctcgtggttttgcgatgggctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataaaaaaaaaaaaaaaaaaaaaatccgggggttttaatgggggggggggaaaaaggggtaggaaaaagggcacatgggtcaataggtgtttccggacccagttttttgggacaaggggggaaaatgggggggcccccaaagggggggcgaaaaatgcgaaaagccgggttacggataaggggaaaat

SEQ ID NO: 319455 - DNA, 806 bp, Homo sapiens
ggacccgcctgcacccgtaacaccgggggcttcccacaaccacaggcagactcccagacctggaaccacttctggaacagaagaccctgaattgagacctggactcaaagagattatcctggaactttaaaagttgacagccctctggatttcggactcccatgggccggtgaacccctttattgttggcccaagtttcgtcccatctggaacaccgtctttaatcaatacctgtacccctgttgtatctaggaagtaactagcttgctctttgagttttaccggctcataaggtggaagggacttgccttgtctcagattaagacctttggactgtggatttttggttaatgctgaaaagagttaagactttgggggactgttaggaaggcatgattggttttgaatagtgagcctcacgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaacactgggagtggacaccagaatgacaaggcaagaacgtccgccagaggaactcttcctgaggcaggtggcccgaggacgctcctgctccgcgtcttgcaagc

SEQ ID NO: 319456 - DNA, 267 bp, Homo sapiens
gtccgagtacgcagaagcctccccagctcacccctggaggacggccggctctctatagtcaccaggctcacgtgggaaccccccttccacccacacgcacataaggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319457 - DNA, 1660 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319458 - DNA, 2019 bp, Homo sapiens
gatcttcccgcctcgacctcccaaggctctgggagtacagacgtgagccacagcggccggcccgtgtttaactcagataaaatctgggtaacacactttcaacgcttcaaccccctcgggcgcaccgctctgcgctcattgcaactttgaaagcaggaaggaagaaatgcgcaggctccagccgcgtccccgcaggccccactcccgtttcctagcaacgccgggtcacgtgcgccgccgcccggattccgtagcgtgagcctgccggagccggcgcgtacatgcgagcgtgtgcgcgcgtgcgcaggcggggcgaccggcgtccccggcgctcgccccgcccccgagatgacgccgtgcgtgcgcgcgcccggtccgcgcctccgccgctttttatagcgcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319459 - DNA, 1718 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaaaaggaggaagaagacggaggcctgggggcggaaaacgaggtgcagggaatggccctg

SEQ ID NO: 319460 - DNA, 1691 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcagattaacccacagcctctacctagccctgtc

SEQ ID NO: 319461 - DNA, 1690 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaaaaaaaaattctagatcgcgagcggccgct

SEQ ID NO: 319462 - DNA, 1697 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaaacatggcgttgtatcgggatcctctagatacacacg

SEQ ID NO: 319463 - DNA, 1669 bp, Homo sapiens
  misc_feature (85)..(85): n is a, c, g, or t
aacaaccaacccccccaccaaaccccccccccccccaccacccaacccacaaccagacagagagacggtgtaaatcggccgaggngtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319464 - DNA, 1804 bp, Homo sapiens
  misc_feature (1)..(1): n is a, c, g, or t
nggcggagaagatgtatacgacgtcactactaggtgcgagatcgcgcacgttacattccggcgtgtaggcgcgcccgcatcaagctgtccgtaattgatgcatgaccatttactaccggaacgtctactgtgaatcacggtccatacatcaggcaccagagctccgtaattcagtccgaagatgcgtggagtgtggagagttagtacggacccgtgcgtagtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319465 - DNA, 1605 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggagcattacactcgccaggggggggtcatccagttagg

SEQ ID NO: 319466 - DNA, 1644 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggagtggggcgatctttattgtggccgtgggtggcgagcgggttcccacgtgagcctgtgctatagatggtaccgaca

SEQ ID NO: 319467 - DNA, 1563 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319468 - DNA, 1053 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagtccagaatgccccgagtacgagctcgatca

SEQ ID NO: 319469 - DNA, 1841 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgtaagttccagctgtgggggtcgggggtcccaaggagcggcctgctgccccaggcctttaaaacacaaaggcagagcccctgggcttcagtattcgggggtcctgggggccggggtgggcaggggtgacttggagagagtgacttgcgggggacaccctctcacccggctctgcacccctggaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319470 - DNA, 1845 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacggtgagtcctgcagtcatggggtaccgggcaccaccgactgtcgggagaagttgttggcctgaggcacccggcacatcccagagccctggccccctgctccctggaggggaacagccctcctgcgggaggccggggatgggggcgggcctgcggttccaggctcctctctctcaccctcctgtcagggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319471 - DNA, 1667 bp, Homo sapiens
tatgaacgtatgcacgtcaaataggacctcatggttgcgtgctctgctcgtgctttgttgcgattctggctgcttagtagctgcctcggatcctcacggtacgtgctggcacggttcttcactaccgtcaagagaaatgttgagatccgagatactcctcatcctgtgtccttggaatgactagtgcctagctaggatggttcacataggttagcagcatagagcatagcacatagcgggagcagttgtgatagctcgtacatgaggtacagctcttgaccctgttgtcagaagatagatcgtgaagtgcgtggtggtctccgactatgcattgcgggatagtacatctctgggttttctcgtacctcactgatcccattgaggcatgttctacatacgcgaagttccatggtacggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319472 - DNA, 1855 bp, Homo sapiens
gatcttcccgcctcgacctcccaaggctctgggagtacagacgtgagccacagcggccggcccgtgtttaactcagataaaatctgggtaacacactttcaacgcttcaaccccctcgggcgcaccgctctgcgctcattgcaactttgaaagcaggaaggaagaaatgcgcaggctccagccgcgtccccgcaggccccactcccgtttcctagcaacgccgggtcacgtgcgccgccgcccggattccgtagcgtgagcctgccggagccggcgcgtacatgcgagcgtgtgcgcgcgtgcgcaggcggggcgaccggcgtccccggcgctcgccccgcccccgagatgacgccgtgcgtgcgcgcgcccggtccgcgcctccgccgctttttatagcgcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319473 - DNA, 1652 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgccggctctgcacccctggaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319474 - DNA, 1176 bp, Homo sapiens
  misc_feature (54)..(54): n is a, c, g, or t
catgtgtttgcattaaatcctcccctgtaataatggcctggacagataataatngagacaagccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319475 - DNA, 1018 bp, Homo sapiens
  misc_feature (832)..(832): n is a, c, g, or t
  misc_feature (846)..(846): n is a, c, g, or t
  misc_feature (869)..(869): n is a, c, g, or t
  misc_feature (930)..(930): n is a, c, g, or t
  misc_feature (932)..(932): n is a, c, g, or t
  misc_feature (934)..(934): n is a, c, g, or t
  misc_feature (943)..(943): n is a, c, g, or t
  misc_feature (946)..(947): n is a, c, g, or t
  misc_feature (1006)..(1007): n is a, c, g, or t
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgaagccgggtngaccctgaaaagangggagcccgatgaaaggagaagncgcagagaactctgaggggggccagagacccgccagttggcgccggacacccgggaaccgncncntaaaacccnganncaaccttaaagggccccgggccggtccggagcacggggggggggccgacggggcgcggnnaagagcatcag

SEQ ID NO: 319476 - DNA, 1013 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgagagccggttgaccctaaagaaggggggccgatgaaaggaaatgtcccaagagacctcgaggagggcgggaccctgtcgtgcgcgggagccccgtgatctcccttaaccggatccaacctttaggggcgagagcctttcgtagacggaccccgagagggggccgccctagcctctattgcgcccgggt

SEQ ID NO: 319477 - DNA, 1420 bp, Homo sapiens
gatcttcccgcctcgacctcccaaggctctgggagtacagacgtgagccacagcggccggcccgtgtttaactcagataaaatctgggtaacacactttcaacgcttcaaccccctcgggcgcaccgctctgcgctcattgcaactttgaaagcaggaaggaagaaatgcgcaggctccagccgcgtccccgcaggccccactcccgtttcctagcaacgccgggtcacgtgcgccgccgcccggattccgtagcgtgagcctgccggagccggcgcgtacatgcgagcgtgtgcgcgcgtgcgcaggcggggcgaccggcgtccccggcgctcgccccgcccccgagatgacgccgtgcgtgcgcgcgcccggtccgcgcctccgccgctttttatagcgcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319478 - DNA, 1563 bp, Homo sapiens
  misc_feature (729)..(729): n is a, c, g, or t
  misc_feature (1006)..(1006): n is a, c, g, or t
gatcttcccgcctcgacctcccaaggctctgggagtacagacgtgagccacagcggccggcccgtgtttaactcagataaaatctgggtaacacactttcaacgcttcaaccccctcgggcgcaccgctctgcgctcattgcaactttgaaagcaggaaggaagaaatgcgcaggctccagccgcgtccccgcaggccccactcccgtttcctagcaacgccgggtcacgtgcgccgccgcccggattccgtagcgtgagcctgccggagccggcgcgtacatgcgagcgtgtgcgcgcgtgcgcaggcggggcgaccggcgtccccggcgctcgccccgcccccgagatgacgccgtgcgtgcgcgcgcccggtccgcgcctccgccgctttttatagcgcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaagtgtggactcgcgactgtaccaagttgggcgcagagtacttccntgcagtctttcctctcgccgagcccaatgaggctgcggcgcatactatcccagtcgtcctacgcggtcgctcccaaggagtgtagaggcatgtcgcacatgtcctggtcaaggaatccaccaagtacagactggaatgcgcgtgcacgaacagagctcgattggctcgtggtaccttggcgagagtccaggatgtttccggtgttcccatcgcttgctacaccttgaacttgcgggccctcgcgttgaccaacaagactctagctttggagcatacnttggaaggcacctacaaggccgcacttacaattcgtacttctgggcgtcgcgtagcagccgacgcgtttgctttcctggcgtacgtttccctacggggagttgggcctcggggtaccacgcacgacttagcactatttgggaggaacccttgtagaccaattgtggaggagcctcgtaccccccgggctccatgtgaccctgggtcgcgacatttgggcgaccccacgcattcccgcaaatgcgcgcgttccttgcacacgaggggcccaatgcgtattcgactgctctcccccgcgggtgtcgctcgcccaggcgctacccgttggggcccagccccattctgggaccccgttcgtccattgggggcgaattcccggttgggccgctgtggagaggtcggcgtggggtcgcttgtggttcaagcctcattcccacttctgtgtccaatccttgagcggaggaagcgccggcccgggatagagcccccggcatgtggaccggtccttgggggaattgagtttgaccggactgcccgcgggtccttgtggttgccccg

SEQ ID NO: 319479 - DNA, 1656 bp, Homo sapiens
  misc_feature (36)..(36): n is a, c, g, or t
agcggagacaattaggctaggtcgaggctgggtgtnggcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319480 - DNA, 1692 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcatgccacccctgtggctggtttcgtgtcccccg

SEQ ID NO: 319481 - DNA, 1626 bp, Homo sapiens
cgatacggctagtcgaggctggtgtgaatcggccgaggataggtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319482 - DNA, 1633 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggagctcacgtgggaacccccctcccacccaccgccacaataaagatcgcccccacctccaccctca

SEQ ID NO: 319483 - DNA, 1627 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccacgtgagccctggtgctatggagagccggccgtcctccaggggtgagctggggaggcttctgcggttctggagtcccggcgatggcgccagttccccagcaaaccccctccagagctgcccccggatgcacagacaaggaggtcgacgcggccgcgaatttagtagtagta

SEQ ID NO: 319484 - DNA, 1379 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaaaaaaaccaaaaagaaagaagaacaagatatatcactaagggaccaagtttaaacataccagtatcttgtacaagggtgaccaataaaaagtagattatacgataggcaactggcagataaataaaaacgcggaacgggcaaaacatggataaatggacaactttgtgaacgacactcattattggagaggaacaaatatagaagatacattacaagaataaaccatgagacaatcagataaaagaaatggacaacaaccattatcacgtgaaattgtagaataatagaatgaaaaataacat

SEQ ID NO: 319485 - DNA, 1685 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggcccgcaatcgtacgcatccctgactctgagttctgcggcggccctgcgtgagtccactccgcacgctgcttcgccaatcattgcgagacggcttttgtgcacgctcattcatagagaaacagcccgaggagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319486 - DNA, 1779 bp, Homo sapiens
gatcttcccgcctcgacctcccaaggctctgggagtacagacgtgagccacagcggccggcccgtgtttaactcagataaaatctgggtaacacactttcaacgcttcaaccccctcgggcgcaccgctctgcgctcattgcaactttgaaagcaggaaggaagaaatgcgcaggctccagccgcgtccccgcaggccccactcccgtttcctagcaacgccgggtcacgtgcgccgccgcccggattccgtagcgtgagcctgccggagccggcgcgtacatgcgagcgtgtgcgcgcgtgcgcaggcggggcgaccggcgtccccggcgctcgccccgcccccgagatgacgccgtgcgtgcgcgcgcccggtccgcgcctccgccgctttttatagcgcggccgcgggcggcggcggcagcggttggaggttgtaggaccggcgaggaataggaatcatggcggctgcgctgttcgtgctgctgggattcgcgctgctgggcacccacggagcctccggggctgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319487 - DNA, 1635 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatggaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319488 - DNA, 1550 bp, Homo sapiens
cgatacggctagtcgaggctggtgtgaatcggccgaggatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacggtgagtcctgcagtcatggggtaccgggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319489 - DNA, 1521 bp, Homo sapiens
gcacaatgaagcagtcggacgcgtctccccaagaaagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgccggctctgcacccctggaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319490 - DNA, 1546 bp, Homo sapiens
gcacaatgaagcagtcggacgcgtctccccaagaaagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgccggctctgcacccctggaagagcagcgggcagcaccagaatgacaaaggcaagaacgtccgccagaggaactcttcctgaggcaggcccgcaatcgtacgcatccctgactctgagttctgcggcggccctgcgtgagtccactccgcacgctgcttcgccaatcattgcgagacggcttttgtgcacgctcattcatagagaaacagcccgaggagattcccatcatacacttccttcttttttaaaaaagttgggttttctccattcaggattctgttccttaggattttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 319491 - DNA, 282 bp, Homo sapiens
ataatcttccaagataaaataaattattggaaaattgatgctcttattttaaatataaataagatagctgtcagatgttaagacagcctaatttatttgaatgcaatattgatcttgccttcttttggaatttaataggtatggtatgatccagaaggctatcactcccttccagcttacctcaacagcctgaataatttccttctgcgagttaacatgtcaaaatacgatgctgcccgacatggtaaagttactaacacaaaagtgtcctgtattgcaact

SEQ ID NO: 319492 - DNA, 7322 bp, Homo sapiens
  misc_feature (1534)..(1534): n is a, c, g, or t
  misc_feature (1681)..(1681): n is a, c, g, or t
  misc_feature (5454)..(5454): n is a, c, g, or t
  misc_feature (7019)..(7019): n is a, c, g, or t
atttcctataaatatcacaaatatttccaacaaaagagcatagatgtcttttatacaattcttttgagaatgattctgcagatttctgcattttctcctcattaatttgacctgggatggttttcactgaggaaaaaaatctttaagcaaacatgttaaatgtttacctatataaaaattattacttcaggtgactccgataatataacgcatgtgtggaatgaggatgatggacagaccttatctccaagcagtctggctgcacagctcctaattctggaaaactttgaagatgccctcttaaatatatcagcaaatagtccttatattccttacttggcatgtgtgagaaatgtgactgacagtttggccagaggttcaccagaaaatctaagactcctgcagtccacaatacgatttaaaaaatcttttcttcgcaatggttcctatgaagattactttcctccagttcctgaagtcctaaaatcaaaactgtctcaacttcgaaacttgaccgaacttctttgtgaatctgaaactttcagtttgatagagaagtcatgccagctctctgatatgagctttgggagcctgtgtgaagaaagtgagtttgatctgcaactcctcgaagcggcagagctgggcaccgaaatagcagccagcttactgtaccatgacaatgtcatatctaaaaaagtgagagatttgctgactggagatccaagcaaaattaatttaaatatggatcagtttctagaacaggcactgcaaatgaattacttggaaaatatcactcagttaataccgatcatagaagccatgctgcatgtcaataacagtgcagatgcttctgaaaagccaggtcagttactagaaatgtttaaaaatgttgaagagctgaaagaagatttaaggagaacaacaggaatgtccaacaggactattgacaagttgctggccattcccatccctgataatagagctgagattatttctcaggtgttctggctgcattcctgtgatactaatatcaccactcccaaactagaagatgcaatgaaagaattctgcaacctgtctctttcagagagatcccggcagtcttacctcatcggactcacccttctgcactacttaaacatttacaacttcacatacaaggtgtttttcccgaggaaagatcaaaagccagtagaaaagatgatggagctcttcataagactaaaagagattctcaatcagatggcttctggcacacatccgctgctagacaaaatgagatccctgaagcaaatgcatctgcccagaagtgttccattaacacaggcaatgtacagaagcaaccgaatgaacacaccacaaggatcatttagcaccatctcccaagcattatgttctcaaggaattaccactgaatatttaactgccatgctgccctcttcccagaggccaaaaggcaaccacaccaaggattttttgacttataaattaactaaagagcaaattgcttcaaaatatggaattcccataaatnccacaccattttgcttctccctttataaagacatcattaacatgcccgctggacctgtgatttgggctttcttgaaacctatgttgttgggaagaattttgtatgcaccatataacccagtcacaaaggcaataatggaaaagtccnatgtaactctgagacagctggcggaattaagagaaaaatctcaagagtggatggataagtcgccacttttcatgaattccttccatctgttaaaccaggcaattccaatgctccagaatactctaaggaacccttttgtgcaagtttttgtaaagttctccgtgggactcgatgctgttgaactattgaaacagatagatgaactcgatattctaagactgaaattagagaacaacattgacatcatcgatcagcttaacacactatcttccctgacagtaaatatttcctcttgtgtattatatgaccgtattcaggcagcaaaaaccatagatgaaatggagagagaggctaaaaggctctacaaaagcaacgaactctttggaagtgttatttttaagcttccttctaacagaagctggcacagaggctatgactctggaaatgtctttcttcctcctgtcataaaatataccatccggatgagtctcaagaccgcacagaccacaagaagcctaagaaccaagatttgggctccagggccacacaattctccatcacacaaccagatctatggcagggcttttatttatttacaggatagtattgaaagagcaatcattgaattgcaaactggaaggaactcccaggaaatagcagtccaggttcaagcaattccttatccctgcttcatgaaagacaacttcctaaccagtgtctcttattctcttccaattgtgcttatggttgcctgggttgtatttatagctgcctttgtaaaaaagcttgtctatgagaaagacctccggcttcatgagtacatgaagatgatgggtgtgaactcctgcagccatttctttgcctggcttatagagagtgttggatttttactggttaccatcgtgatcctcatcattatactcaagtttggcaatattcttcctaaaacaaatgggttcattttgttcctgtatttttcggactacagcttctcggttattgccatgagctatcttatcagtgtcttcttcaacaacaccaacattgcagctctgatcggaagcctcatctacatcattgccttctttccatttattgttctggttacagtggagaatgagttgagctatgtattgaaagtgttcatgagcctgctgtccccaacagcattcagctatgcaagccaatacattgcacgatacgaagaacagggcattggtcttcagtgggaaaatatgtacacctccccggttcaggatgacaccacctcatttggctggctgtgctgtctaatcctagctgactctttcatttatttccttattgcttggtatgtcaggaatgtcttcccagggacatacggtatggcagctccctggtattttccaattcttccttcctattggaaggagcgatttgggtgtgcagaggtgaagcctgagaagagcaatggcctcatgtttactaacatcatgatgcagaacaccaacccatctgccagtcctgaatacatgttttcctctaacatcgagcctgaacctaaagatctcacagtcggggttgccctgcatggggtcacaaagatctatggctcaaaagttgctgttgataacctcaatctgaacttttatgaagggcatattacttcattgctggggcccaatggagctgggaaaactactaccatttccatgttaactgggctgtttggggcctcagcaggcaccatttttgtatatggaaaagatatcaaaacagacctacacacggtacggaagaacatgggagtctgtatgcagcacgacgtcttgttcagttacctcactactaaggagcaccttctcctatatggttccatcaaagttcctcactggactaaaaagcagctccacgaggaagtaaaaaggactttaaaagatactggactatatagccatcgtcataagagagttggaacactgtcaggaggcatgaagaggaagttatctatatccatagctctcattggtggatcaagggtagtaattttggatgaaccatctactggagttgacccatgttctcgccgaagtatatgggatgttatatccaagaacaaaactgccagaacaatcattctgtcaacgcaccacttggacgaggctgaagtgctgagtgaccgcatcgccttcctggagcagggtgggcttaggtgctgtgggtccccattttacctcaaggaagcctttggcgatgggtatcacctcacgcttaccaagaagaagagtccaaatttaaatgcaaatgcagtatgtgacaccatggccgtgacagcaatgatccaatcacatctccccgaagcctacctcaaggaggatattgggggagagcttgtttatgtacttcctccattcagcaccaaagtctcaggggcctacctgtcactcctacgggcactcgacaatggcatgggtgacctcaacatcgggtgctacggcatttcagataccaccgtggaggaggtctttctgaacttgaccaaagagtcacaaaaaaatagtgctatgagtcttgagcacttaacacaaaagaaaattgggaattccaatgccaatggcatctcaactcctgacgatttatctgtgagcagcagcaatttcacagacagagatgacaaaatcctgacaagaggagagaggctggatggctttggactgttgctgaagaagatcatggctatactcatcaagaggttccaccacacccgcaggaactggaaaggtctcattgctcaggttatcctccccatcgtctttgttaccactgccatgggccttggcacactgagaaattccagcaacagttatccagagattcagatctccccctctctttatggtacctccgaacagacagccttctatgctaattatcacccgagcacggaagcacttgtctcagcaatgtgggacttccctggaattgacaacatgtgtctgaacaccagtgatctacagtgtttaaacaaagacagtctggaaaaatggaacaccagtggagaacccatcactaattttggtgtttgctcctgctcagaaaatgtccaggaatgtcctaaatttaactattccccaccgcacagaagaacttactcatcccaggtaatttataacctcactgggcaacgagtggaaaattatcttatatcaactgcaaatgagtttgtccaaaaaagatatggaggttggagttttgggctgcctttgacaaaagaccttcgttttgatataacaggagtccctgccaatagaacacttgccaaggtatggtatgatccagaaggctatcactcccttccagcttacctcaacagcctgaataatttccttctgcgagttaacatgtcaaaatacgatgctgcccgacatggcatcatcatgtatagccatccttatccaggagtgcaagaccaagaacaagccacaatcagcagtttaatcgatattttagtggcactgtctatcttgatgggctactctgtcaccaccgccagctttgtcacctatgttgtaagggaacatcaaaccaaagccaaacagttgcagcacatttcaggcattggcgtgacatgctactgggtaacaaacttcatttatgacatggttttctacttggtgcctgtagcgttttcaattggtatcattgcgattttcaaattacctgcattctacagtgaaaacaacctaggcgctgtatctctcctacttctcctgtttgggtatgcaacattttcntggatgtacttgctggctgggctcttccatgaaacaggaatggccttcatcacttacgtctgtgtcaacttgttttttggcattaattccattgtttccctgtcagtggtatactttctttccaaggaaaagcctaatgatccgactttagaacttatttctgaaaccctcaagcgcattttcctgattttcccacaattctgttttggctacggtttgattgaactttctcaacaacagtcggtcctagacttcttaaaagcatatggagtggaatacccaaatgaaacctttgagatgaataaactaggtgcaatgtttgtggctttggtttctcagggcaccatgtttttttccttgcgactcttaatcaacgaatccctgataaagaaactcaggcttttcttcagaaaatttaattcttcacatgtaagggagacaatagatgaggatgaagatgtgcgggctgagagattaagagttgagagtggtgcagctgaatttgacttggtccaactttattgtctcacaaagacctaccaacttatccacaaaaagattatagctgtaaacaacatcagcattgggatacctgctggagagtgttttgggcttcttggagtgaatggagcaggaaagaccactatattcaagatgctgacaggagacatcattccttcaagtggaaacattctgatcagaaataagaccggatctctgggtcacgttgattctcacagctcattagttggctactgtcctcaggaagatgccttagatgacctggtaactgtggaagaacatttgtatttctatgccagggtacatggaattccagaaaaggatattaaagaaactgttcataaactccttaggagacttcacctgatgcccttcaaggacagagctacctctatgtgcagttatggcacaaaaagaaaattatccactgcactggccttgatagggaaaccttccattctactgctggatgagccgagctctggcatggatccgaagtcgaaacggcacctctggaagatcatttcagaagaagtacagaacaaatgttccgtcatcctcacatctcacagcatggaagaatgtgaagctctctgtaccaggttggccattatggtgaatggaaagtttcaatgtattggatctttgcagcacataaagagcaggtttggacgaggatttactgtcaaagttcacttgaagaataacaaagtgaccatggagaccctcacaaagttcatgcagctgcactttccaaaaacatacttaaaagatcagcacctcagcatgctagagtatcatgtaccagtcacagcaggaggagtcgcaaacatttttgatctgctggaaaccaacaagactgctttaaatattacaaatttcttagtgagtcagaccactctggaagaggttttcatcaactttgccaaagaccagaagtcctatgaaactgctgataccagcagccaaggttccactataagtgttgactcacaagatgaccagatggagtcttaacacttccagcaaactcaatctcagcntgtgaccaatggcttcattttgaagaaaagccacagaagatacacttccgcaagatatcttcattttaaagtaaagtaatatactgtatggaaagttacaactgtgttagactaacaagtaattataaaaggaaatttttccttctaaggtcagtgagtgttgttgctactgaaatgaattcctgtatactcaacactgtgagcatgctaatgtatatgctggtgattcttatgcaaaggtgaagccacctcaagatgaatatcttaatttattactttcaataaaaagacagtttaaaaggc

SEQ ID NO: 319493 - DNA, 699 bp, Homo sapiens
ggagaaacttggtgtccaggggaggcccccggcggctggagcgcggcggcagcgggcgcagaggccggagggagaggaggcgaggggcggcccgagcgcggggcgggagcgaggccagcggtcatgtgcccgtgccccctgcaccgcggccgcggccccccggccgtgtgcgcctgcagcgcgggtcgcctggggctgcgctcgtccgccgcgcagctcaccgccgcccggctcaaggcgctaggcgacgagctgcaccagcgcaccatgtggcggcgccgcgcgcggagccggagggcgccggcgcccggcgcgctccccacctactggccttggctgtgcgcggccgcgcaggtggcggcgctggcggcctggctgctcggcaggcggaacttgtaggaacgcggggcttcttggtggggccggagccgagacccagccggagcgagcaacaggttggtgaaaaccctgtgtccttggagaaagctggttcccgttttccagagggggagcccagagcttgaaaggccgcggttggcacttcgagaaggaagtggagagtaaagacagcgcctggagcgatcgtagaaacacagaatgggactggggaagccctttggaaatccagctgcagaaacagacaccccaatgctatttacatacagctctatatatataaaaaaagaaaatatgaatatt

SEQ ID NO: 319494 - DNA, 1842 bp, Homo sapiens
ggagaaacttggtgtccaggggaggcccccggcggctggagcgcggcggcagcgggcgcagaggccggagggagaggaggcgaggggcggcccgagcgcggggcgggagcgaggccagcggtcatgtgcccgtgccccctgcaccgcggccgcggccccccggccgtgtgcgcctgcagcgcgggtcgcctggggctgcgctcgtccgccgcgcagctcaccgccgcccggctcaaggcgctaggcgacgagctgcaccagcgcaccatgtggcggcgccgcgcgcggagccggagggcgccggcgcccggcgcgctccccacctactggccttggctgtgcgcggccgcgcaggtggcggcgctggcggcctggctgctcggcaggcggaacttgtaggaacgcggggcttcttggtggggccggagccgagacccagccggagcgagcaacagcctacatctgacctcagaataccagccgctccggcctttcttgtgcttttgatttaatttggggaaactcattttttcccagctctgagccccaggggaggctcctctgaggctggggaggcctggaggaggatgggtatgatttaaccagtcaatactcaaagatacaggagagagggaacaaaagacgctttatggtggttgagatcttcccatgtcaacacgcaaaggttttcctcatcctttttaatggctgcatgatgttctgttgcttggatgaaccaggatttccttatatggtcacttccttgggaacatttgcattgtttcctgttttctggttggtgaaaaccctgtgtccttggagaaagctggttcccgttttccagagggggagcccagagcttgaaaggccgcggttggcacttcgagaaggaagtggagagtaaagacagcgcctggagcgatcgtagaaacacagaatgggactggggaagccctttggaaatccagctgcagaaacagacaccccaatgctatttacatacagctctatatatataaaaaaagaaaatatgaatattacgtatcagtgcatgccttgttgaggacgtggttgccttccttttctgcaccttgcgatgtgaactttgatattctgtaatgtctggggcgccagaagagagatgcctgctgtgtacttagaaactatttgcaaagactggtgggaattagccccagcatcggccaactgcctggggatagatgctggtggaataagaggtaacagtgcaaaaggcatgatagaaaaaaaaagtgaggacttgggaccgattgtgtaggggcagtctgggatgcctccatttcttgactcgtcctagcctctccctctgtacttacctaggtcgatcgctagatcccactgtcacgtcaagagaaatgggatttttgtgtctctggtgcttcacttaaaattttgctggtgctaagtgcgttcctgctggtgctgctgtggtattctgttgacagacttggaaggccaggggacaagagagatttctattttgctgtttcagattcttttttttttttttttaagggacaagttgcaaaagtgccacttgagagtctcttctcttcttctacctggggacgaatatccagaggtggtttggagcaaaccttggggtctaggagggaggatggcattgagaggcttgctggttatgaggcagaaagctgacctcatgcatgacttggttgctatctcccccacccccacaaaagtgtcctcggagttcagcccacagcctcctccactccccaaggggatttcagggtttaggttttatggattaaagagccaagaaatggctacattctgttc

SEQ ID NO: 319495 - DNA, 1502 bp, Homo sapiens
ggagaaacttggtgtccaggggaggcccccggcggctggagcgcggcggcagcgggcgcagaggccggagggagaggaggcgaggggcggcccgagcgcggggcgggagcgaggccagcggtcatgtgcccgtgccccctgcaccgcggccgcggccccccggccgtgtgcgcctgcagcgcgggtcgcctggggctgcgctcgtccgccgcgcagctcaccgccgcccggctcaaggcgctaggcgacgagctgcaccagcgcaccatgtggcggcgccgcgcgcggagccggagggcgccggcgcccggcgcgctccccacctactggccttggctgtgcgcggccgcgcaggtggcggcgctggcggcctggctgctcggcaggcggaacttgtaggaacgcggggcttcttggtggggccggagccgagacccagccggagcgagcaacaggttggtgaaaaccctgtgtccttggagaaagctggttcccgttttccagagggggagcccagagcttgaaaggccgcggttggcacttcgagaaggaagtggagagtaaagacagcgcctggagcgatcgtagaaacacagaatgggactggggaagccctttggaaatccagctgcagaaacagacaccccaatgctatttacatacagctctatatatataaaaaaagaaaatatgaatattacgtatcagtgcatgccttgttgaggacgtggttgccttccttttctgcaccttgcgatgtgaactttgatattctgtaatgtctggggcgccagaagagagatgcctgctgtgtacttagaaactatttgcaaagactggtgggaattagccccagcatcggccaactgcctggggatagatgctggtggaataagaggtaacagtgcaaaaggcatgatagaaaaaaaaagtgaggacttgggaccgattgtgtaggggcagtctgggatgcctccatttcttgactcgtcctagcctctccctctgtacttacctaggtcgatcgctagatcccactgtcacgtcaagagaaatgggatttttgtgtctctggtgcttcacttaaaattttgctggtgctaagtgcgttcctgctggtgctgctgtggtattctgttgacagacttggaaggccaggggacaagagagatttctattttgctgtttcagattcttttttttttttttttaagggacaagttgcaaaagtgccacttgagagtctcttctcttcttctacctggggacgaatatccagaggtggtttggagcaaaccttggggtctaggagggaggatggcattgagaggcttgctggttatgaggcagaaagctgacctcatgcatgacttggttgctatctcccccacccccacaaaagtgtcctcggagttcagcccacagcctcctccactccccaaggggatttcagggtttaggttttatggattaaagagccaagaaatggctacattctgttc

SEQ ID NO: 319496 - DNA, 831 bp, Homo sapiens
ggagaaacttggtgtccaggggaggcccccggcggctggagcgcggcggcagcgggcgcagaggccggagggagaggaggcgaggggcggcccgagcgcggggcgggagcgaggccagcggtcatgtgcccgtgccccctgcaccgcggccgcggccccccggccgtgtgcgcctgcagcgcgggtcgcctggggctgcgctcgtccgccgcgcagctcaccgccgcccggctcaaggcgctaggcgacgagctgcaccagcgcaccatgtggcggcgccgcgcgcggagccggagggcgccggcgcccggcgcgctccccacctactggccttggctgtgcgcggccgcgcaggtggcggcgctggcggcctggctgctcggcaggcggaacttgtaggaacgcggggcttcttggtggggccggagccgagacccagccggagcgagcaacagcctacatctgacctcagaataccagccgctccggcctttcttgtgcttttgatttaatttggggaaactcattttttcccagctctgagccccaggggaggctcctctgaggctggggaggcctggaggaggatgggtatgatttaaccagtcaatactcaaagatacaggagagagggaacaaaagacgctttatgggaagcttcatggaaagggacatgaattttggagtcaggccgactttcacatcactttctccatctcgcatttgccagttgtgtgaccttaggccgatcccattaccttctgagccttggtttcctcatctgtaaaatgggaagaataatagcatctgtgctggaggagcactatgtat

SEQ ID NO: 319497 - DNA, 609 bp, Homo sapiens
attgcatttagaccattgtcaaactccttaaattggcctcggagacctgtgatggccaatcttccccacccctgtgggtcaggttcctctggtgtgggcctatctcttagtgcaaggctccctgtagactgtcctggggctgcctgtctaaatgcaatcagtttatatcgggatcgcgatttttctttcttggtggggctgtttatgaagagtctaaatgcaatcatgattgcatttagaccctccagaaggggctgggcccggggtcctgcaggcggcaccttttggtagagtttgtttccctggaaaatggggaaaatgtttcaagccaggtgaggggggaagttaacactgaaatatgtattgtttttaaaaatcaaatgcacacgcatggaagctgcttgtccatgcactggttttgtcactggcgtcctggaatccgaccgtgttggggtgcaggcgctgtcagactccggctgatcctggctcgagcacacacatctaagggccaggctggttccgcatggtgatctccgtcttgtatgtctgaatgttggcctaaaataaagattactgttgtaaaataaatgttttcactgcggaaaaaac

SEQ ID NO: 319498 - DNA, 5552 bp, Homo sapiens
ggctgcagtgcacagtattttgcaactagtttgtgatttctccttgctcattctctctgctgttctttttattttaattaattaatttattttgtttatttatatatttgtttttaaggaacagggtccctgtctcctgggctccagtgcagtggagtgatcatagctcactgcagcctcaaactcctgggctcaagcggtcctcccgcctcagcctcccaaaatgctgggactacaggtgtgagcccctgtgccggcccacagtacacagctgcagttcttcaggatctcttggggtggccgtattctgccgtctcacacttctccatgccatggcgtctgtctgtgcacgtggcaaactccacaaggcagtgttggattcttttgctttgaacggtcttatggaataaagtccatcagctctgcccttggtactttcatctatactttgtgatactttctttttattttttcttctagaatagcctaacatggcagaccagagacagcgctcactgtctacctctggggagtcattgtaccacgtccttgggttggacaagaacgcaacctcagatgacattaaaaagtcctatcggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagagggaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctgaagggcggcctgggaaggggccctgtgctggccccgggtccgccccagaggagtccacacagcaccacctccagaaggggctgggcccggggtcctgcaggcggcaccttttggtagagtttgtttccctggaaaatggggaaaatgtttcaagccaggtgaggggggaagttaacactgaaatatgtattgtttttaaaaatcaaatgcacacgcatggaagctgcttgtccatgcactggttttgtcactggcgtcctggaatccgaccgtgttggggtgcaggcgctgtcagactccggctgatcctggctcgagcacacacatctaagggccaggctggttccgcatggtgatctccgtcttgtatgtctgaatgttggcctaaaataaagattactgttgtaaaataaatgttttcactgcggaaaaaac

SEQ ID NO: 319499 - DNA, 5772 bp, Homo sapiens
cgctgccggtgccgcacccgcgccctctgccgccgccgccgccgccgcccggggtctccaggctgaggagtgcgtcggccgctgcccagcagcgccgcgaatcggggagcggagccgcggagccggcgggagggcgggcgggcgggcggacgggcagaatagcctaacatggcagaccagagacagcgctcactgtctacctctggggagtcattgtaccacgtccttgggttggacaagaacgcaacctcagatgacattaaaaagtcctatcggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagaggggagggcactgacactgtgccgcgagtgtttgtggtggcagctgggactgttgaggtgtgaacgtggaccctgagaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctgaagggcggcctgggaaggggccctgtgctggccccgggtccgccccagaggagtccacacagcaccacctccagaaggggctgggcccggggtcctgcaggcggcaccttttggtagagtttgtttccctggaaaatggggaaaatgtttcaagccaggtgaggggggaagttaacactgaaatatgtattgtttttaaaaatcaaatgcacacgcatggaagctgcttgtccatgcactggttttgtcactggcgtcctggaatccgaccgtgttggggtgcaggcgctgtcagactccggctgatcctggctcgagcacacacatctaagggccagcttgggaagggggctcctgtgctcggccccgggtccgcccagaggtagtccacacagtaccaacctccagtaaggggctggcccggggtccctgcaggcggacctttttggtagagtttgtttcccctggaaaatggggaacaatgttttccagcccacgtgaacgggggaagttaacactgaaaatatgtatgtttttacaatcaaatgcacacgcatggaagctgttgtccatggcactggttttgtcactggggtctggaatccggaccgtggtgggggtgcaggcgctgtcagactccggggtgatcctggtcgagggcacccatctaagggcccgggtgctgccgctggggactccggcggtatgctgaaatgtggggctaaaataagagtacgggggggcctcaacagcaaacaaccaccgcacacaccaacaaagacacacacaccccacacaccacacgccgagctgcaaaaccaaacacacacgcggcggtcaatacaagccccccacaaaacagccaacaacatagggcgcaaacgacgggaaacggtgcccaacg

SEQ ID NO: 319500 - DNA, 5111 bp, Homo sapiens
cgctgccggtgccgcacccgcgccctctgccgccgccgccgccgccgcccggggtctccaggctgaggagtgcgtcggccgctgcccagcagcgccgcgaatcggggagcggagccgcggagccggcgggagggcgggcgggcgggcggacgggcagaatagcctaacatggcagaccagagacagcgctcactgtctacctctggggagtcattgtaccacgtccttgggttggacaagaacgcaacctcagatgacattaaaaagtcctatcggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagaggggagggcactgacactgtgccgcgagtgtttgtggtggcagctgggactgttgaggtgtgaacgtggaccctgagaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctgaagggcggcctgggaaggggccctgtgctggccccgggtccgccccagaggagtccacacagcaccacctccagaaggggctgggcccggggtcctgcaggcggcaccttttggtagagtttgtatttttagtaggaatggggtttctccatgttgctcaggctggtctcgaactcccaacctcaggtgatctgcctgcctcatcctcccaaagtgctgggattacaggcatgagccacccag

SEQ ID NO: 319501 - DNA, 4184 bp, Homo sapiens
  misc_feature (4083)..(4083): n is a, c, g, or t
cgctgccggtgccgcacccgcgccctctgccgccgccgccgccgccgcccggggtctccaggctgaggagtgcgtcggccgctgcccagcagcgccgcgaatcggggagcggagccgcggagccggcgggagggcgggcgggcgggcggacgggcagaatagcctaacatggcagaccagagacagcgctcactgtctacctctggggagtcattgtaccacgtccttgggttggacaagaacgcaacctcagatgacattaaaaagtcctatcggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagaggggagggcactgacactgtgccgcgagtgtttgtggtggcagctgggactgttgaggtgtgaacgtggaccctgagaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggcggaacnaagcgggaaggaaggccaagggatctgaccggaaagtttctgcggaagggcaacactcacggtcgctggggaccggttgggacagaaacgtgcccctttgg

SEQ ID NO: 319502 - DNA, 1091 bp, Homo sapiens
  misc_feature (22)..(22): n is a, c, g, or t
tagaggttcccatgcaataacntgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctgaagggcggcctgggaaggggccctgtgctggccccgggtccgccccagaggagtccacacagcaccacctccagaaggggctgggcccggggtcctgcaggcggcaccttttggtagagtttgtttccctggaaaatggggaaaatgtttcaagccaggtgaggggggaagttaacactgaaatatgtattgtttttaaaaatcaaatgcacacgcatggaagctgcttgtccatgcactggttttgtcactggcgtcctggaatccgaccgtgttggggtgcaggcgctgtcagactccggctgatcctggctcgagcacacacatctaagggccaggctggttccgcatggtgatctccgtcttgtatgtctgaatgttggcctaaaataaagattactgttgtaaaataaatgttttcactgcggaaaaaac

SEQ ID NO: 319503 - DNA, 2754 bp, Homo sapiens
cgctgccggtgccgcacccgcgccctctgccgccgccgccgccgccgcccggggtctccaggctgaggagtgcgtcggccgctgcccagcagcgccgcgaatcggggagcggagccgcggagccggcgggagggcgggcgggcgggcggacgggcagaatagcctaacatggcagaccagagacagcgctcactgtctacctctggggagtcattgtaccacgtccttgggttggacaagaacgcaacctcagatgacattaaaaagtcctatcggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagaggggagggcactgacactgtgccgcgagtgtttgtggtggcagctgggactgttgaggtgtgaacgtggaccctgagaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgctggttccgcatggtgatctccgtcttgtatgtctgaatgttggcctaaaataaagattactgttgtaaaataaatgttttcactgcggaaaaaac

SEQ ID NO: 319504 - DNA, 890 bp, Homo sapiens
ggctgcagtgcacagtattttgcaactagtttgtgatttctccttgctcattctctctgctgttctttttattttaattaattaatttattttgtttatttatatatttgtttttaaggaacagggtccctgtctcctgggctccagtgcagtggagtgatcatagctcactgcagcctcaaactcctgggctcaagcggtcctcccgcctcagcctcccaaaatgctgggactacaggtgtgagcccctgtgccggcccacagtacacagctgcagttcttcaggatctcttggggtggccgtattctgccgtctcacacttctccatgccatggcgtctgtctgtgcacgtggcaaactccacaaggcagtgttggattcttttgctttgaacggtcttatggaataaagtccatcagctctgcccttggtactttcatctatactttgtgatactttctttttattttttcttctagaatagcctaacatggcagaccagagacagcgctcactgtctacctctggggagtcattgtaccacgtccttgggttggacaagaacgcaacctcagatgacattaaaaagtcctatcggaagcttgccttgaaatatcaccccgacaagaaccccgacaacccggaggccgcggacaagtttaaggagatcaacaacgcgcacgccctggctccagctcagattcacttcctctcgtacttggatgcttggtgatggtcgtggaagccgttttattttctcttgctgttctcctgttgcgttaagctcagcatcactgttgctttttattcttagaattaaggaggaaagctgaaatcttttggggatttctgtgtttcccgggacctttaggaattccttttttttttt

SEQ ID NO: 319505 - DNA, 5229 bp, Homo sapiens
cgctgccggtgccgcacccgcgccctctgccgccgccgccgccgccgcccggggtctccaggctgaggagtgcgtcggccgctgcccagcagcgccgcgaatcggggagcggagccgcggagccggcgggagggcgggcgggcgggcggacgggcagaatagcctaacatggcagaccagagacagcgctcactgtctacctctggggagtcattgtaccacgtccttgggttggacaagaacgcaacctcagatgacattaaaaagtcctatcggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagagggaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctgaagggcggcctgggaaggggccctgtgctggccccgggtccgccccagaggagtccacacagcaccacctccagaaggggctgggcccggggtcctgcaggcggcaccttttggtagagtttgtttccctggaaaatggggaaaatgtttcaagccaggtgaggggggaagttaacactgaaatatgtattgtttttaaaaatcaaatgcacacgcatggaagctgcttgtccatgcactggttttgtcactggcgtcctggaatccgaccgtgttggggtgcaggcgctgtcagactccggctgatcctggctcgagcacacacatctaagggccaggctggttccgcatggtgatctccgtcttgtatgtctgaatgttggcctaaaataaagattactgttgtaaaataaatgttttcactgcggaaaaaac

SEQ ID NO: 319506 - DNA, 5303 bp, Homo sapiens
cgctgccggtgccgcacccgcgccctctgccgccgccgccgccgccgcccggggtctccaggctgaggagtgcgtcggccgctgcccagcagcgccgcgaatcggggagcggagccgcggagccggcgggagggcgggcgggcgggcggacgggcagaatagcctaacatggcagaccagagacagcgctcactgtctacctctggggagtcattgtaccacgtccttgggttggacaagaacgcaacctcagatgacattaaaaagtcctatcggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagaggggagggcactgacactgtgccgcgagtgtttgtggtggcagctgggactgttgaggtgtgaacgtggaccctgagaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctgaagggcggcctgggaaggggccctgtgctggccccgggtccgccccagaggagtccacacagcaccacctccagaaggggctgggcccggggtcctgcaggcggcaccttttggtagagtttgtttccctggaaaatggggaaaatgtttcaagccaggtgaggggggaagttaacactgaaatatgtattgtttttaaaaatcaaatgcacacgcatggaagctgcttgtccatgcactggttttgtcactggcgtcctggaatccgaccgtgttggggtgcaggcgctgtcagactccggctgatcctggctcgagcacacacatctaagggccaggctggttccgcatggtgatctccgtcttgtatgtctgaatgttggcctaaaataaagattactgttgtaaaataaatgttttcactgcggaaaaaac

SEQ ID NO: 319507 - DNA, 4558 bp, Homo sapiens
cgctgccggtgccgcacccgcgccctctgccgccgccgccgccgccgcccggggtctccaggctgaggagtgcgtcggccgctgcccagcagcgccgcgaatcggggagcggagccgcggagccggcgggagggcgggcgggcgggcggacgggcagaatagcctaacatggcagaccagagacagcgctcactgtctacctctggggagtcattgtaccacgtccttgggttggacaagaacgcaacctcagatgacattaaaaagtcctatcggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagaggggagggcactgacactgtgccgcgagtgtttgtggtggcagctgggactgttgaggtgtgaacgtggaccctgagaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctga

SEQ ID NO: 319508 - DNA, 3319 bp, Homo sapiens
cgctgccggtgccgcacccgcgccctctgccgccgccgccgccgccgcccggggtctccaggctgaggagtgcgtcggccgctgcccagcagcgccgcgaatcggggagcggagccgcggagccggcgggagggcgggcgggcgggcggacgggcagaatagcctaacatggcagaccagagacagcgctcactgtctacctctggggagtcattgtaccacgtccttgggttggacaagaacgcaacctcagatgacattaaaaagtcctatcggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagaggggagggcactgacactgtgccgcgagtgtttgtggtggcagctgggactgttgaggtgtgaacgtggaccctgagaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctca

SEQ ID NO: 319509 - DNA, 2708 bp, Homo sapiens
cgctgccggtgccgcacccgcgccctctgccgccgccgccgccgccgcccggggtctccaggctgaggagtgcgtcggccgctgcccagcagcgccgcgaatcggggagcggagccgcggagccggcgggagggcgggcgggcgggcggacgggcagaatagcctaacatggcagaccagagacagcgctcactgtctacctctggggagtcattgtaccacgtccttgggttggacaagaacgcaacctcagatgacattaaaaagtcctatcggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagaggggagggcactgacactgtgccgcgagtgtttgtggtggcagctgggactgttgaggtgtgaacgtggaccctgagaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacaggggtgggaaagaggagcaggtctggaggtttgtggaacccagtcccctgcagaatctgtaaaacctaataaatcatggttgtggccattctca

SEQ ID NO: 319510 - DNA, 239 bp, Homo sapiens
gcttttttgttttcatcagactgataaaaacccaataaacaactccaggggttggcaaactttttattaaaaggacacattataactattttaagattaaggtccatactgtttctgtcacaactactcaactctcttatcagagatcaaaatgtaaacaagtaggtatgtctatgttccaataaaactttatttgcaaaataagcaattggctttttgtagggggttagatatagggg

SEQ ID NO: 319511 - DNA, 171 bp, Homo sapiens
catggtcttaatagttggagctcatttataatacttgtttttgtgtcattttctgataattccatcatctcgttcttttctggtcttcatttagtgattttattttattgatagttttctgcttctttgcatgcctcagtattctttgaaatttttatttatttacttttt

SEQ ID NO: 319512 - DNA, 962 bp, Homo sapiens
  misc_feature (31)..(31): n is a, c, g, or t
  misc_feature (51)..(51): n is a, c, g, or t
cagaaagagatagctgagcataggatctganggcctctgggttggttaaantcgagagggctggcatgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaataaaaaaaacaaaaaccgggtctttgcgggcggggacagcggatgcaagggcgtggccaatgctccgaccgttcgccacagggcacatcgggccaatgaggcaaatcagcgcgactgc

SEQ ID NO: 319513 - DNA, 187 bp, Homo sapiens
tcaagcttctaacgatgtacggggacatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaa

SEQ ID NO: 319514 - DNA, 1609 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaa

SEQ ID NO: 319515 - DNA, 1806 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggtgaggcctgcccgccgcgaagagggggtgatctcggcgacccccggcatgttcgaggctgctccgggagcccagccgcccgggagcgccccaccggcggggaacgggtcggagctgcagtgggacgcgggggcggtgggatacggggggtctcgacacctctctgggccgtaatcgccttcgcttctccccggcaggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaa

SEQ ID NO: 319516 - DNA, 977 bp, Homo sapiens
ggtgcaggggacgttgctgggaatcaaacttgacttgtaaagccaataaaagccacttggagaattggcctcagatcttgtctgcaactgtccctgtaaaggtgaggaaactgaaacacactgagctgaacaggagcctttggagagaacgctctggaccggtgagtgagccatgaggtcgggccacaggctctgaagtcgtgaagccttgggacggagcgggtggtgcttcgaggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaa

SEQ ID NO: 319517 - DNA, 1798 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaaaaaaacacaaaagaaaacagacacatgtcaaataggagaaaacaagaagggaggggagaaaccaaaaggagaaaacctaaaggagagcgacggggggccgggcaaacaatggcctcagaaaggggggcggactcagggaggaacggcatgtcgccaaggacggcacacgtagagacgggaaggggaacg

SEQ ID NO: 319518 - DNA, 690 bp, Homo sapiens
gcctccagggctcaagcaatcttctcacctcagcatccggagtagccgagactacaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaa

SEQ ID NO: 319519 - DNA, 1555 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaa

SEQ ID NO: 319520 - DNA, 1949 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagagtaagatatttgaatattttgtgcataatttaggatgacaggtggaatagtatatattgacctttctttataacagaagttgaaatatttaatacaactggtctgaatgagaacaagcagacaggggaatcttggactatcccaggcatgtcatatacctacactaactactctccatcactgcaatggggcaggggatttctgagacatgtagtaaagtgctttaaaatttattccttccttcctgattaaaaacccataaggggaaggatatggtagcttacgcctgtaagcccagcacttcgggaggccgagacgggtggatcatctgaggtcaggagttagagaccagcctggccaatgtggtgaaaccccatctctactaaaaatacaaaaattagctgggcatggtggtacacacctgtaatctcagctactcgggaggctgaggcaggagaatcacttgaacccgggaggcagttgcagtgagctgagatcatgtcactgaactccagcctgggcaagagcaagacacttcatca

SEQ ID NO: 319521 - DNA, 1577 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagagtaagatatttgaatattttgtgcataatttaggatgacaggtggaatagtatatattgacctttctttataacagaaggtccaggtatgccagaaggtccaggtatgccagaaggtccaggtatgccagaaggtccagtatgccagaagctccagtatgccagaagtcc

SEQ ID NO: 319522 - DNA, 466 bp, Homo sapiens
atccccatcagggcagaagcaggaagcagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaa

SEQ ID NO: 319523 - DNA, 1510 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaa

SEQ ID NO: 319524 - DNA, 1979 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggtgaggcctgcccgccgcgaagagggggtgatctcggcgacccccggcatgttcgaggctgctccgggagcccagccgcccgggagcgccccaccggcggggaacgggtcggagctgcagtgggacgcgggggcggtgggatacggggggtctcgacacctctctgggccgtaatcgccttcgcttctccccggcaggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggagaccaacagattctaaagcttaattaagctttttgatcagaaaaaaacccaacttggatacatcggagtaaaaactgcttctctcacctgctctacttatttcccttcagcatttctagtgagtcttactacatgcacaagtaagaaatacttttatgctgtttaatgttcagggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaa

SEQ ID NO: 319525 - DNA, 1276 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgcatcagcggatcgagtgggtacccg

SEQ ID NO: 319526 - DNA, 870 bp, Homo sapiens
tatgcatactcttaaaacatggttgtaccaatttacacctctacgacagtggttccatacccttgccaacttcattttgttcattgtaggcattctcttgggtgtatagtgttattgcattttggttttaatttgcatttccctaatgactaatgcagttgaacacctttccaaatgataattggccatttggacatcatctttcttgaagatcaagtcttgctcatttttccaatgggtcgtttgctatttttcttactgattcccaggaatcctttctatattctgaataccagtcctttgtattacaaatatgttgtactctgtgacttgttttatttttcaattttccagtttatgttgttgattgttttacttcatcccagaccaacagattctaaagcttaattaagctttttgatcagaaaaaaacccaacttggatacatcggagtaaaaactgcttctctcacctgctctacttatttcccttcagcatttctagtgagtcttactacatgcacaagtaagaaatacttttatgctgtttaatgttcagggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaa

SEQ ID NO: 319527 - DNA, 1177 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatcagcggatcgagtgggaacctctagatca

SEQ ID NO: 319528 - DNA, 1170 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggatgaagcatacccagggaagaagctgttgccggatgacccctatgagaaagcttgccagaagatgatcttagagttgttttctaaggtttgtgcataagaaatttcagctc

SEQ ID NO: 319529 - DNA, 844 bp, Homo sapiens
  misc_feature (31)..(31): n is a, c, g, or t
  misc_feature (51)..(51): n is a, c, g, or t
cagaaagagatagctgagcataggatctganggcctctgggttggttaaantcgagagggctggcatgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaa

SEQ ID NO: 319530 - DNA, 1208 bp, Homo sapiens
tgtctgtgtatatatagcacatgaggtcaattttcctttgcctttaatgaatcacctggtgcactaagatattccacccccccactccccacacgctcattcgcacccatgctgacacctacgtgtacatgcgggatggtgcccatgcacgcctgtgcttacacacatgcacacacaaatatgcacagaacacacatctgtatgtgtgttagcaaagagactcctgaactccctctgatggctgaagccatctctcccctgtgaggcacaggtggcctgggttgcttgcacttggggcgtggctgggatctattgtctgagagggtgaggacaccacgcaaatttagacaagcccatgagatcaggctgggcccatggtgaaagtcccacacttagtcaatacccactcatctggaatattgtctccacagccccagccacagctgcaggcctgggcttccagcgggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaa

SEQ ID NO: 319531 - DNA, 1146 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaa

SEQ ID NO: 319532 - DNA, 1716 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggtgaggcctgcccgccgcgaagagggggtgatctcggcgacccccggcatgttcgaggctgctccgggagcccagccgcccgggagcgccccaccggcggggaacgggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaa

SEQ ID NO: 319533 - DNA, 1853 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaaaaaacacacaaaaaaaaaaccgggggcataaacggggcggaacaaggtacaaacgggccagtgcaatgaggtaccggacccagtttgggacacggggaacacgcgggcccaaaggagggaaaaataagagcgtcgagagaagacaaacaagtacaaccacacacacacacaacacacaacgacaaccaacagcaaagcaagaggaagagcacaaacaaaacacatacaaagaagacagcaataa

SEQ ID NO: 319534 - DNA, 1852 bp, Homo sapiens
  misc_feature (1628)..(1628): n is a, c, g, or t
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaaaaaaaaaaaaaaaaaaatnaaaaaaaaaaaggggggacacatagtgcggggggcggggaaaaagaggggatcagagaacgggcgccaagggggcacaaagcgggttcctgggaaccaaagttttctctgtggtccaaacaaggggggaacaattcgcgcaggggaacccacacaaaaagggagggccggaaataaatcgcaaaataagcccagggaaacccggggataagaaggcggcacaaa

SEQ ID NO: 319535 - DNA, 1636 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaaatatgaataatagcatgcttttatttt

SEQ ID NO: 319536 - DNA, 1960 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggtgaggcctgcccgccgcgaagagggggtgatctcggcgacccccggcatgttcgaggctgctccgggagcccagccgcccgggagcgccccaccggcggggaacgggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaaaaaacacacaaaaaaaaaaccgggggcataaacggggcggaacaaggtacaaacgggccagtgcaatgaggtaccggacccagtttgggacacggggaacacgcgggcccaaaggagggaaaaataagagcgtcgagagaagacaaacaagtacaaccacacacacacacaacacacaacgacaaccaacagcaaagcaagaggaagagcacaaacaaaacacatacaaagaagacagcaataa

SEQ ID NO: 319537 - DNA, 1563 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgcgttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaa

SEQ ID NO: 319538 - DNA, 2122 bp, Homo sapiens
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagccaaaataaagaagactatgctggcctaaaagaagaatttcgtaaagaatttaccaagctagaggagaccaacagattctaaagcttaattaagctttttgatcagaaaaaaacccaacttggatacatcggagtaaaaactgcttctctcacctgctctacttatttcccttcagcatttctagtgagtcttactacatgcacaagtaagaaatacttttatgctgtttaatgttcagggttctgactaataagaagacgaccttctttggtggcaattctatctctatgattgattacctcatctggccctggtttgaacggctggaagcaatgaagttaaatgagagtaagatatttgaatattttgtgcataatttaggatgacaggtggaatagtatatattgacctttctttataacagaagttgaaatatttaatacaactggtctgaatgagaacaagcagacaggggaatcttggactatcccaggcatgtcatatacctacactaactactctccatcactgcaatggggcaggggatttctgagacatgtagtaaagtgctttaaaatttattccttccttcctgattaaaaacccataaggggaaggatatggtagcttacgcctgtaagcccagcacttcgggaggccgagacgggtggatcatctgaggtcaggagttagagaccagcctggccaatgtggtgaaaccccatctctactaaaaatacaaaaattagctgggcatggtggtacacacctgtaatctcagctactcgggaggctgaggcaggagaatcacttgaacccgggaggcagttgcagtgagctgagatcatgtcactgaactccagcctgggcaagagcaagacacttcatca

SEQ ID NO: 319539 - DNA, 483 bp, Homo sapiens
ctcttggagaaaagcattctaggcaaagcaatagcaagtacaaatattctcaagagattcacagggcttgctcagggggcagaagcaggaagcaagggtcttgggaggggcagaagcaggaagcagtggcctaaaagaagaatttcgtaaagaatttaccaagctagaggaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaa

SEQ ID NO: 319540 - DNA, 1753 bp, Homo sapiens
  misc_feature (1529)..(1529): n is a, c, g, or t
agttatgcattcgtctagtgcttggtgaatctgcatttttacaagattaaatatagggtagaggaagcggtcaaattgcatttttctccagcgagaggaaggatgactcctagacctgtctttgtcccatacttgggaagataagctgttagtttacattgccaagatgaaattcaactgatctgttttagagtaaagatcttgcgggccaacaaggaatttccttggggaggtgtgtggcctttgatctttgtagctatttagcaacaaaatgggaggcagtgttgcctgactcagtttccaagcttgactcttccctttggcatagtgagtttggagtcaagagatttttattttcccttcacaagctgaacaggagcctttggagagaacgctctggaccggtgagtgagccatgaggtcgggccacaggctctgaagtcgtgaagccttgggacggagcgggtggtgcttcgaggtcagtgtcacgggagggaggtcagggtcagggtcagacgtggagccccgtggagtgcggagtggtgaccccttcgttcgggggcggagggatgactgagcatttataacttttgtgtatctccccgtgggtgcagcccttggccagcgagatgctttgacacagccccttaagatgttttaagggctatcccataaagccgggaaggcacaacgggtggagctggcggccgccgggggcaggcacttttgagctaaggaggaagcgggggagggaaggagggcgggaaggacgcgccacctacttcctgaatcccctgcaaaccccagaggagctcggcctgcgctgcgccacgatgtccggggagtcagccaggagcttggggaagggaagcgcgcccccggggccggtcccggagggctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggttctgactaataagaagacgaccttctttggtggcaattctatctctatgattgattacctcatctggccctggtttgaacggctggaagcaatgaagttaaatgagtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaaaaaaaaaaaaaaaaaaatnaaaaaaaaaaaggggggacacatagtgcggggggcggggaaaaagaggggatcagagaacgggcgccaagggggcacaaagcgggttcctgggaaccaaagttttctctgtggtccaaacaaggggggaacaattcgcgcaggggaacccacacaaaaagggagggccggaaataaatcgcaaaataagcccagggaaacccggggataagaaggcggcacaaa

SEQ ID NO: 319541 - DNA, 566 bp, Homo sapiens
ttttttaggtagtgggtggtgagcttaaccctggaaaatgaatccctctatctctaaagaaaatctctgtgaaacccctacgtggaggcggaattgctctcccagcccttgcattgcagaggggtgggaaagattactttttctttatgtgtttgacgggaaacaaaactaggtaaaatctacagtacaccacaagggtcacaatactgttgtgcgcacatcgcggtagggcgtggaaaggggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtacattcttcctgattattttctacacatacatgtaaaatatgtctttcttttttaaatagggttgtactatgctgttatgagtggctttaatgaataaacatttgtagcatcctctttaatgggtaaacagcaaaaaaaacga

SEQ ID NO: 319542 - DNA, 2207 bp, Homo sapiens
cgaaaaggagggtgactctcctcggcgggggcttcgggtgacatcacatcctccaaatgcgaaatcaggctccgggccggccgaagggcgcaactttcccccctcggcgccccaccggctcccgcgcgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaccacaggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttccagtcttcctccctgtgtattcattctcatgattattattttagtgggggcggggtgggaaagattactttttctttatgtgtttgacgggaaacaaaactaggtaaaatctacagtacaccacaagggtcacaatactgttgtgcgcacatcgcggtagggcgtggaaaggggcaggccagagctacccgcagagttctcagaatcatgctgagagagctggaggcacccatgccatctcaacctcttccccgcccgttttacaaagggggaggctaaagcccagagacagcttgatcaaaggcacacagcaagtcagggttggagcagtagctggagggaccttgtctcccagctcagggctctttcctccacaccattcaggtctttctttccgaggcccctgtctcagggtgaggtgcttgagtctccaacggcaagggaacaagtacttcttgatacctgggatactgtgcccagagcctcgaggaggtaatgaattaaagaagagaactgcctttggcagagttctataatgtaaacaatatcagactttttttttttataatcaagcctaaaattgtatagacctaaaataaaatgaagtggtgagcttaaccctggaaaatgaatccctctatctctaaagaaaatctctgtgaaacccctatgtggaggcggaattgctctcccagcccttgcattgcagaggggcccatgaaagaggacaggctacccctttacaaatagaatttgagcatcagtgaggttaaactaaggccctcttgaatctctgaatttgagatacaaacatgttcctgggatcactgatgactttttatactttgtaaagacaattgttggagagcccctcacacagccctggcctctgctcaactagcagatacagggatgaggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtacattcttcctgattattttctacacatacatgtaaaatatgtctttcttttttaaatagggttgtactatgctgttatgagtggctttaatgaataaacatttgtagcatcctctttaatgggtaaacagcaaaaaaaacga

SEQ ID NO: 319543 - DNA, 2096 bp, Homo sapiens
cgaaaaggagggtgactctcctcggcgggggcttcgggtgacatcacatcctccaaatgcgaaatcaggctccgggccggccgaagggcgcaactttcccccctcggcgccccaccggctcccgcgcgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttccagtcttcctccctgtgtattcattctcatgattattattttagtgggggcggggtgggaaagattactttttctttatgtgtttgacgggaaacaaaactaggtaaaatctacagtacaccacaagggtcacaatactgttgtgcgcacatcgcggtagggcgtggaaaggggcaggccagagctacccgcagagttctcagaatcatgctgagagagctggaggcacccatgccatctcaacctcttccccgcccgttttacaaagggggaggctaaagcccagagacagcttgatcaaaggcacacagcaagtcagggttggagcagtagctggagggaccttgtctcccagctcagggctctttcctccacaccattcaggtctttctttccgaggcccctgtctcagggtgaggtgcttgagtctccaacggcaagggaacaagtacttcttgatacctgggatactgtgcccagagcctcgaggaggtaatgaattaaagaagagaactgcctttggcagagttctataatgtaaacaatatcagactttttttttttataatcaagcctaaaattgtatagacctaaaataaaatgaagtggtgagcttaaccctggaaaatgaatccctctatctctaaagaaaatctctgtgaaacccctatgtggaggcggaattgctctcccagcccttgcattgcagaggggcccatgaaagaggacaggctacccctttacaaatagaatttgagcatcagtgaggttaaactaaggccctcttgaatctctgaatttgagatacaaacatgttcctgggatcactgatgactttttatactttgtaaagacaattgttggagagcccctcacacagccctggcctctgctcaactagcagatacagggatgaggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtacattcttcctgattattttctacacatacatgtaaaatatgtctttcttttttaaatagggttgtactatgctgttatgagtggctttaatgaataaacatttgtagcatcctctttaatgggtaaacagcaaaaaaaacga

SEQ ID NO: 319544 - DNA, 1006 bp, Homo sapiens
cgaaaaggagggtgactctcctcggcgggggcttcgggtgacatcacatcctccaaatgcgaaatcaggctccgggccggccgaagggcgcaactttcccccctcggcgccccaccggctcccgcgcgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaccacagaaccgaagacgtgtttgcaaatgtccccggcctgtggtcaaatcgggcagacaagcccaggcttacaggcgacaatacgatcttacccctgttgccaacaatccaactacaattacctccaaacctgcacgattcccttacctcttgcacggaacccaacttcattcccctattcaatataattccacgacctatccatcc

SEQ ID NO: 319545 - DNA, 1706 bp, Homo sapiens
ccctctgcggtgagacctgcagaacaggaattggtgccgggtcagcagccggcgatgaagccggacgaagcctgcaaaccccacccatacgccagcttcacatagctcctatccattgcacagcagcgtggggaagcaccgttctctaccctccaaacaaaagcatgaaccaggtgcagtggctcacgtctgtaatcccagcattttggaggccaaggtggatggatggattccttgagtccaggagttcaagaccagcctgggcaacatggtgaacccccatctctacaaaaatttagccagggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttccagtcttcctccctgtgtattcattctcatgattattattttagtgggggcggggtgggaaagattactttttctttatgtgtttgacgggaaacaaaactaggtaaaatctacagtacaccacaagggtcacaatactgttgtgcgcacatcgcggtagggcgtggaaaggggcaggccagagctacccgcagagttctcagaatcatgctgagagagctggaggcacccatgccatctcaacctcttccccgcccgttttacaaagggggaggctaaagcccagagacagcttgatcaaaggcacacagcaagtcagggttggagcagtagctggagggaccttgtctcccagctcagggctctttcctccacaccattcaggtctttctttccgaggcccctgtctcagggtgaggtgcttgagtctccaacggcaagggaacaagtacttcttgatacctgggatactgtgcccagagcctcgaggaggtaatgaattaaagaagagaactgcctttggcagagttctataatgtaaacaatatcagactttttttttttataatcaagcctaaaattgtatagacctaaaataaaatgaagtggtgagcttaaccctggaaaatgaatccctctatctctaaagaaaatctctgtgaaacccctatgtggaggcggaattgctctcccagcccttgcattgcagaggggcccatgaaagaggacaggctacccctttacaaatagaatttgagcatcagtgaggttaaactaaggccctcttgaatctctgaatttgagatacaaacatgttcctgggatcactgatgactttttatactttgtaaagacaattgttggagagcccctcacacagccctggcctctgctcaactagcagatacagggatgaggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtacattcttcctgattattttctacacatacatgtaaaatatgtctttcttttttaaatagggttgtactatgctgttatgagtggctttaatgaataaacatttgtagcatcctctttaatgggtaaacagcaaaaaaaacga

SEQ ID NO: 319546 - DNA, 843 bp, Homo sapiens
cgaaaaggagggtgactctcctcggcgggggcttcgggtgacatcacatcctccaaatgcgaaatcaggctccgggccggccgaagggcgcaactttcccccctcggcgccccaccggctcccgcgcgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaccacagtaagtcccgaggaatcgcggcgggaaggagtcggcccc

SEQ ID NO: 319547 - DNA, 2202 bp, Homo sapiens
ctagtctttcagccttcaggctgtttttggcttgaagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaggctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctatcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttctttttt

SEQ ID NO: 319548 - DNA, 2471 bp, Homo sapiens
ctccacccctactcgccctctctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaggctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctatcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttttttttttttttttttattttttttatttttttttttttttttttttttatttattttatatct

SEQ ID NO: 319549 - DNA, 2177 bp, Homo sapiens
ctccacccctactcgccctctctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaggctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgcaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctatcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttctttttt

SEQ ID NO: 319550 - DNA, 1345 bp, Homo sapiens
ctccctactttttccattcaggccagaaacaaaaagaagagcctaaggtaacatttttccctcatactgtttcaagtggtagaagatgggatagcttgggctatcaaccacagacatgtctgtctggattataggaagagccccaaagggagggtcgaaccagttgctaccttacagagtccatgagctagggaccttcttaatagcctcctccactatcatgcacacacttcctactacccaagctagtgggccagatcttactcagtaggaattcctgtccaagcaagggttgggctaaaggacctctgaaggccttttaggctactgtgaaaccagttacttactggcctctcccctgctgtattgggtaccccctgtgccaaatcacgaaactgcggtgatccaggatgttgagagaaagcctcagacactcaggagttccctttgtttcctccccactcaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgcaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctatcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttctttttt

SEQ ID NO: 319551 - DNA, 1727 bp, Homo sapiens
ctccacccctactcgccctctctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaggctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaacaaaaagaagagcctaaggaagtgaagctcagtgttcccatgccctacacactcaaggtgctagctagccagctgtgttcacactgtaaacattcatcaagctgtacatttggtgcacttttctgtgtcataccacaataaaaaaaaacctatcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttctttttt

SEQ ID NO: 319552 - DNA, 897 bp, Homo sapiens
ctccacccctactcgccctctctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaactgtacatttggtgcacttttctgtgtcataccacaataaaaaaaaacctatcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttctttttt

SEQ ID NO: 319553 - DNA, 351 bp, Homo sapiens
gttatacaaattgcacctcaattaaaaacatttcttttttaagagagaagaaagcaagcctgtgttagcaggggtggggtgaatgctcgtttcttcagttgctgaaatcctaatccagaggctcaggaatctaatccttagttactgtccacgtctgaaaccaggctcacgtaagaacaggtctagggcatgagcaaagagggagacccagaagaatggaaacagtgctggcagagcctcacaccctcctgtccttgattttaggtcgtggcatctgtggtggatcaagacagtttctctgggtttgcccctctgcaaccacaggtaaggcagtcctgaccttctccatgg

SEQ ID NO: 319554 - DNA, 685 bp, Homo sapiens
cttacagagtccatgagctagggaccttcttaatagcctcctccactatcatgcacacacttcctactacccaagctagtgggccagatcttactcagtaggaattcctgtccaagcaagggttgggctaaaggacctctgaaggccttttaggctactgtgaaaccagttacttactggcctctcccctgctgtattgggtaccccctgtgccaaatcacgaaactgcggtgatccaggatgttgagagaaagcctcagacactcaggagttccctttgtttcctccccactcaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgaggtgagctccatgcaggcagctgtgaggggtacagtgggaaccttgtgctggcctggaggagggaagaggaggatggtttttgtgatgatgttctttgactggattcttactcattatccccacccagctatcggcctcgggacagcaatgagctggtgcccctttcagaagacagcatgaaggatgcctggggccaggtgaaaaactactgcctgactctgtggtgtgagaacacag

SEQ ID NO: 319555 - DNA, 2407 bp, Homo sapiens
ctccacccctactcgccctctctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaggctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctatcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttctttttt

SEQ ID NO: 319556 - DNA, 2221 bp, Homo sapiens
ctccacccctactcgccctctctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaggctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttcccgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctatcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttctttttt

SEQ ID NO: 319557 - DNA, 1091 bp, Homo sapiens
ctccacccctactcgccctctctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaacaaagtttttgttgaagactgcgcaactacagatttggaaagcactcggagagaagtctaggatgtttcacaaactacaaagctgaagtgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctatcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttctttttt

SEQ ID NO: 319558 - DNA, 2689 bp, Homo sapiens
acgccccgggcatgcgcagcggctcgctcggaagctgcgacgccgagtttcactctggctgccttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaagaagcgaccccgaagccagagccagagccagagcaggtcataaaaaactacacggaagagctgaaagtgcccccagatgaggactgcatcatctgcatggagaagctgtccgcagcgtctggatacagcgatgtgactgacagcaaggcaatcgggtccctggctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggcatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagccaaagcca

SEQ ID NO: 319559 - DNA, 2524 bp, Homo sapiens
acgccccgggcatgcgcagcggctcgctcggaagctgcgacgccgagtttcactctggctgccttctcctgagagtcggagccacagccagagccctgcccaggccgagccggagctgcagcccgagcgcggtggtgccctcagccccgtcctcttgtcctcctcagcctcgatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaagaagcgaccccgaagccagagccagagccagagcaggtcataaaaaactacacggaagagctgaaagtgcccccagatgaggactgcatcatctgcatggagaagctgtccgcagcgtctggatacagcgatgtgactgacagcaaggcaatcgggtccctggctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggcatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagccaaagcca

SEQ ID NO: 319560 - DNA, 487 bp, Homo sapiens
cttgggttgggagtggcagggccaggcgtgtgggtgtcaggagcccaggcacaaggccccagagtcccagaggagactcagacgggccctagccctttcggtctcctgtcttgagccaaggtggatcgtagggcctggggcagggtgggaagataacggggcagcaggcagcgggcactggctgccagccaaggtccacctgtggtggatggaggcatctttttgtcttgttgaaccatgagcctttcccctggtttccctccacttctccacagctcagagggaaattcaggaacattcggggttggcatctcggagcgggggaggagctggagctgtgcaggggcctgtccctgtgcgggctctcggagcaccctatcctggtgtggggcgagtagagacttccccagcctggacgggcgtgggttctgggtcagcttcttttacctcaattttgtttgcaataaatgctctatagccaaagcca

SEQ ID NO: 319561 - DNA, 2548 bp, Homo sapiens
acgccccgggcatgcgcagcggctcgctcggaagctgcgacgccgagtttcactctggctgccttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcagaagcgaccccgaagccagagccagagccagagcaggtcataaaaaactacacggaagagctgaaagtgcccccagatgaggactgcatcatctgcatggagaagctgtccgcagcgtctggatacagcgatgtgactgacagcaaggcaatcgggtccctggctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggcatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagccaaagcca

SEQ ID NO: 319562 - DNA, 2809 bp, Homo sapiens
acgccccgggcatgcgcagcggctcgctcggaagctgcgacgccgagtttcactctggctgccttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaaggatctggtactgttctggagtggcctgtagcagacactgaaccaccagccagctgcatttgttgtcctggaagtcattgccaactctgccagtcacactggggtccccaaagaagtcaagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaagaagcgaccccgaagccagagccagagccagagcaggtcataaaaaactacacggaagagctgaaagtgcccccagatgaggactgcatcatctgcatggagaagctgtccgcagcgtctggatacagcgatgtgactgacagcaaggcaatcgggtccctggctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggcatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagccaaagcca

SEQ ID NO: 319563 - DNA, 2895 bp, Homo sapiens
acgccccgggcatgcgcagcggctcgctcggaagctgcgacgccgagtttcactctggctgccttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagaacacggctggcagatccagctcctcgtatagtgccttcacccgggccaccttctcggcctccttctgcctgtaattttccttcaggatctggtactgttctggagtggcctgtagcagacactgaaccaccagccagctgcatttgttgtcctggaagtcattgccaactctgccagtcacactggggtccccaaagaagtcaagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaagaagcgaccccgaagccagagccagagccagagcaggtcataaaaaactacacggaagagctgaaagtgcccccagatgaggactgcatcatctgcatggagaagctgtccgcagcgtctggatacagcgatgtgactgacagcaaggcaatcgggtccctggctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggcatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagccaaagcca

SEQ ID NO: 319564 - DNA, 1930 bp, Homo sapiens
cctggcagtggggctggatactggcctgcctcccaccagagtccccccagctcctccctgctgtgggctggcctgggaggaagggggtggggtgcacttacatttgcaggtctttccagcccctggggcagcctgattaaccagcttctccagggccaagctgttgggggtgaggtgcagcccgaagcagccagaccagcccctgagcctcccgggtgctggcagctgtcatggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagcgaggccgccacactgccggtgggctgcaagcctgggctggaccccctccccagcctcagcccctagcctggcctctttgcatggggctgggggagatggggcgccgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctggtctcgtgatagtgagtgagtgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaaaaaaaaagaaaagaaaaaagaaaaaaaagaggacaaaaagaaaaaaacaaacacacgctggggcgcgcccgacataaagtagccgcaaggggggacgacactggcagacgacagaccacaagcgtaagtagaacaagaagggcgccaataagtagggggaggcacgacatgtacagacaacggagaaaacggccgcgccgcgccccgcgggagagccaaacggcgcgcgatggagggcagcagcacacggcaacgaagacgagagcaccaatcgagcggggaaagaagcacacaggctgctcgcggcgccggcgggctacacaacaagcggggagcaccgcatccgccacggcgaggcacgtaaggcgccacccgacggggggagcgagataggacg

SEQ ID NO: 319565 - DNA, 1850 bp, Homo sapiens
cctggcagtggggctggatactggcctgcctcccaccagagtccccccagctcctccctgctgtgggctggcctgggaggaagggggtggggtgcacttacatttgcaggtctttccagcccctggggcagcctgattaaccagcttctccagggccaagctgttgggggtgaggtgcagcccgaagcagccagaccagcccctgagcctcccgggtgctggcagctgtcatggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagcgaggccgccacactgccggtgggctgcaagcctgggctggaccccctccccagcctcagcccctagcctggcctctttgcatggggctgggggagatggggcgccgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctggtctcgtgatagtgagtgagtgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaaaaaaaaagaaaagaaaaaagaaaaaaaagaggacaaaaagaaaaaaacaaacacacgctggggcgcgcccgacataaagtagccgcaaggggggacgacactggcagacgacagaccacaagcgtaagtagaacaagaagggcgccaataagtagggggaggcacgacatgtacagacaacggagaaaacggccgcgccgcgccccgcgggagagccaaacggcgcgcgatggagggcagcagcacacggcaacgaagacgagagcaccaatcgagcggggaaagaagcacacaggctgctcgcggcgccggcgggctacacaacaagcggggagcaccgcatccgccacggcgaggcacgtaaggcgccacccgacggggggagcgagataggacg

SEQ ID NO: 319566 - DNA, 2015 bp, Homo sapiens
cctggcagtggggctggatactggcctgcctcccaccagagtccccccagctcctccctgctgtgggctggcctgggaggaagggggtggggtgcacttacatttgcaggtctttccagcccctggggcagcctgattaaccagcttctccagggccaagctgttgggggtgaggtgcagcccgaagcagccagaccagcccctgagcctcccgggtgctggcagctgtcatggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagcgaggccgccacactgccggtgggctgcaagcctgggctggaccccctccccagcctcagcccctagcctggcctctttgcatggggctgggggagatggggcgccgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctggtctcgtgatagtgagtgagtgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaaaaaaaaagaaaagaaaaaagaaaaaaaagaggacaaaaagaaaaaaacaaacacacgctggggcgcgcccgacataaagtagccgcaaggggggacgacactggcagacgacagaccacaagcgtaagtagaacaagaagggcgccaataagtagggggaggcacgacatgtacagacaacggagaaaacggccgcgccgcgccccgcgggagagccaaacggcgcgcgatggagggcagcagcacacggcaacgaagacgagagcaccaatcgagcggggaaagaagcacacaggctgctcgcggcgccggcgggctacacaacaagcggggagcaccgcatccgccacggcgaggcacgtaaggcgccacccgacggggggagcgagataggacg

SEQ ID NO: 319567 - DNA, 1587 bp, Homo sapiens
gccctgagggaggaggtggcatggggggtcagggctggagactgggcgaacacagaacccccactcataaggacaaagctgctttctcccctcccacctccatctgttctctcctcctgcagcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagcgaggccgccacactgccggtgggctgcaagcctgggctggaccccctccccagcctcagcccctagcctggcctctttgcatggggctgggggagatggggcgccgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctggtctcgtgatagtgagtgagtgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaaaaaaaaagaaaagaaaaaagaaaaaaaagaggacaaaaagaaaaaaacaaacacacgctggggcgcgcccgacataaagtagccgcaaggggggacgacactggcagacgacagaccacaagcgtaagtagaacaagaagggcgccaataagtagggggaggcacgacatgtacagacaacggagaaaacggccgcgccgcgccccgcgggagagccaaacggcgcgcgatggagggcagcagcacacggcaacgaagacgagagcaccaatcgagcggggaaagaagcacacaggctgctcgcggcgccggcgggctacacaacaagcggggagcaccgcatccgccacggcgaggcacgtaaggcgccacccgacggggggagcgagataggacg

SEQ ID NO: 319568 - DNA, 1111 bp, Homo sapiens
aagcctctttttccaagactggcccacgtcagcccagcccactgttggcgagcatgacccatgtttggtctcctccaggactgcatcatctgcatggagaagctgtccgcagcgtctggatacagcgatgtgactgacagcaaggcaatcgggtccctggctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggcatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagccaaagcca

SEQ ID NO: 319569 - DNA, 1752 bp, Homo sapiens
  misc_feature (184)..(184): n is a, c, g, or t
  misc_feature (246)..(246): n is a, c, g, or t
  misc_feature (567)..(567): n is a, c, g, or t
gtgtgcacagacagcgagtgaggccgtcagggtgggctcctgccacgtcttggcccctccccagagtcgctggacttaggagctagtctgcatgtgacagaccttcccagtcagtggcaggcgtttcccgggacagtgtctgtgtggcggtcggcgtgtgtgcagctgcctgtacatgctggancccagactcccttgtccctgtgatgttcatgccagggtaatgcaagttgaatcaaatcgtgntgccacaacgccccctggagtagtttgtgcccgaagcggctgtctgactcttccgcgcagcctcagaagcgccggggtcggttcctcactcaatgtgcgcggggatgcggctcccaggagactgtgctgctgtttctgctcttctgcatcctccatggctcctggggctgagccgggtccccggacggtgggactggggaaggctttgcccgacggagctcggggctctgtgcctggcgctgagctctcccgtcccgcacactggcctccctgtctgggcccctctcgcatttcctcctggcagcttagacctcttccttnccttcctcgccctctggcctcctctccagcctgtgctcctcaggacgctgcttatgtacttctctcttctagaagcgaccccgaagccagagccagagccagagcaggtcataaaaaactacacggaagagctgaaagtgcccccagatgaggactgcatcatctgcatggagaagctgtccgcagcgtctggatacagcgatgtgactgacagcaaggcaatcgggtccctggctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggcatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagccaaagcca

SEQ ID NO: 319570 - DNA, 2754 bp, Homo sapiens
acgccccgggcatgcgcagcggctcgctcggaagctgcgacgccgagtttcactctggctgccttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagaaacttccaattgaagacactgagctgaaccattccgcccgcccgcccgcccgagggcactccagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaagaagcgaccccgaagccagagccagagccagagcaggtcataaaaaactacacggaagagctgaaagtgcccccagatgaggactgcatcatctgcatggagaagctgtccgcagcgtctggatacagcgatgtgactgacagcaaggcaatcgggtccctggctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggcatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagccaaagcca

SEQ ID NO: 319571 - DNA, 2887 bp, Homo sapiens
  misc_feature (2887)..(2887): n is a, c, g, or t
acgccccgggcatgcgcagcggctcgctcggaagctgcgacgccgagtttcactctggctgccttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaagaagcgaccccgaagccagagccagagccagagcaggtcataaaaaactacacggaagagctgaaagtgcccccagatgaggactgcatcatctgcatggagaagctgtccgcagcgtctggatacagcgatgtgactgacagcaaggcaatcgggtccctggctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggcatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagccaaagccaaaaaaaaacaaaaaaaacacctcaaggaaaaaaagtcgcggcgccgcaaaacacaggaacaacaaatcgcacacaggagccaacaccgggacacacgagaccaaaataccaggacacaagcggccaacaaagggaggaccccatatagcgagccgcactaaccggacaaaccccgacaccctgcatcacgaccgggan

SEQ ID NO: 319572 - DNA, 1098 bp, Homo sapiens
cctggcagtggggctggatactggcctgcctcccaccagagtccccccagctcctccctgctgtgggctggcctgggaggaagggggtggggtgcacttacatttgcaggtctttccagcccctggggcagcctgattaaccagcttctccagggccaagctgttgggggtgaggtgcagcccgaagcagccagaccagcccctgagcctcccgggtgctggcagctgtcatggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagcgaggccgccacactgccggtgggctgcaagcctgggctggacccttccactagcctactgcccttgctgggggggacatggccgggttgtggcttgcctctcc

SEQ ID NO: 319573 - DNA, 2095 bp, Homo sapiens
cctggcagtggggctggatactggcctgcctcccaccagagtccccccagctcctccctgctgtgggctggcctgggaggaagggggtggggtgcacttacatttgcaggtctttccagcccctggggcagcctgattaaccagcttctccagggccaagctgttgggggtgaggtgcagcccgaagcagccagaccagcccctgagcctcccgggtgctggcagctgtcatggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagcgaggccgccacactgccggtgggctgcaagcctgggctggaccccctccccagcctcagcccctagcctggcctctttgcatggggctgggggagatggggcgccgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcaggctggtctcgtgatagtgagtgagtgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaaaaaaaaagaaaagaaaaaagaaaaaaaagaggacaaaaagaaaaaaacaaacacacgctggggcgcgcccgacataaagtagccgcaaggggggacgacactggcagacgacagaccacaagcgtaagtagaacaagaagggcgccaataagtagggggaggcacgacatgtacagacaacggagaaaacggccgcgccgcgccccgcgggagagccaaacggcgcgcgatggagggcagcagcacacggcaacgaagacgagagcaccaatcgagcggggaaagaagcacacaggctgctcgcggcgccggcgggctacacaacaagcggggagcaccgcatccgccacggcgaggcacgtaaggcgccacccgacggggggagcgagataggacg

SEQ ID NO: 319574 - DNA, 133 bp, Homo sapiens
ctcactggtaatggtaattttcaccatctggtgaaagtatggtccagtttctccacagtatagttactatatttcccttacaacaaataagcaatctgtggggaatctacatccttcttgttactttcttatc

SEQ ID NO: 319575 - DNA, 664 bp, Homo sapiens
gatggagtgaaatgcagggcaaatgtcttaaaggaaatgacagattctaagaggcgggctagtggcttgtaacccacatggaagaggttatgaaaggacgatagaatggaatgagcctgtgaggctggaaagaggtattttccttggtctaagaaccatttgccttgagtggggagggatttataggtggaaacttcagtgggagagtaagtaggagtgactaatgagaaagagagaaactggccatgagggacagaagtaggaatactggctccttctttagctgtcttatcagcataactgttgccttgagcagtggggtctgaggtcctttgatggcctttgcagtgaatggctccaccttcctttggaagtaaagcgtccttgcgaagggtttttattaaagaggcattaatgatggaggacccttgctcactaggaaacttctttcagcccgtatggtggtgcaggacgtcagaggcatatttaaagccagtataaatattgacacgcaatccttttgcaagagtgagggctcaagttaaggcaatgagttaggcttgctgagaggtagtggagtggaccagagcggtagcctcaatgatagatgtataagatactatatcatagcctgcctttgctggtgagtggcgattaggcctgg

SEQ ID NO: 319576 - DNA, 980 bp, Homo sapiens
  misc_feature (976)..(976): n is a, c, g, or t
gagctcctgacctcgtgatccgcccacctcggcctcccaaagcgctgggattacaggcgtgagcaccgcgcccggccagcgactgcatttatagaggactcttaagatcagggagaagcccatacttctctagaaataaggaaggtgttttaattctcaggaggtcaacaagtcctgaggacggacttcagttgatgcatttccctttgaactggactctgccctcgatttcataacacagggcacggggttagctgtggtaggaagagttgtctccagccactcctaacccaacccagggctcaaagaccagtgtgtgagcctcagggggcgtgtctctaagctcccggaaaccaagccaattttcgcatgcgtgttcttctttgctttttttctggtaagaggacccacagttgcatcaaactttcaaagggacctgggacccctcagaaaagatctagaagcactgttctagggagagaaacagaaaaacagagtctgaagggcagtggagggaggaggccttccaagaaggcctggacacccgacctggaggggaaacgcgtttgtaggggaggaagggctccctctgcctctcacgggctcccacggctgtgatctgaattatctctccacactctccctgagggatcgagagcagtaaagggcaacgtcctgtcttctctctgatctgggagcccctgagaagccagcattcttctctcccagcttacctcttcctttggctgtattttccagggtaagaaaaagaagaggaagagagaaaagcagctgtcccagacacagtcacagcagcaagtccaggaggcagagggtgcgtctcggggcactggcctcttctcctgcttttccttttgtcacagccacacctgcccatgctgtctctagctccctgatgggtcagggcttctgcctcggtattcgcgggcgggtattattacccctttctcgaggnggcc

SEQ ID NO: 319577 - DNA, 479 bp, Homo sapiens
  misc_feature (264)..(264): n is a, c, g, or t
catgttgatggtacttcaagccatgagactggaggagatccctgagactgaagctgagaaaaaaagaggtcaagggctgagccgtgggcactacagcttttgcacactggagagaagagcaagaactggcaaaggagactgagaaggagcagccagagagtacctgcagatgaaatggcccctcctcgatgtcccctccagcgccacagtcaaggacacgaggtcaccatctccagcacacttgtctaataaagttcctgtcgntcagcacaggcacccatctcagggtccagcgtgacctccaatggggtcagcatagtcaccaactctgagttccatacaacctcgagtgggatcagcacaggcaccaactctgagttcagaacagcgtccagtgggatcagcatagccaccaactctgagtccagcacaacctccagtggggccagcacagccaccaactctgagtccagcacacc

SEQ ID NO: 319578 - DNA, 1183 bp, Homo sapiens
ctggctggggaagacgggaaatcacaatggcagagctgcagatggagtcggggaagctggggcaggcggcaggggcgagaagagacaggagacagaaagtgcaagagaggtaagagcgagaagtgccctctgcccaggtccatgcccacagctctgctggcctctcccccgtccttccccgccacgctccatgcccaccaggccctcccggtgctacaggcccagcctctttccctggtcaccaagtctgcccactaagctccccccgacccctgcaggctgtcacatgactcattgagtagtaatgattcagaagaaaaagaaaaaggagactttattggtcaatatttgaccactctggactgttctgtaaagtggctggtaacaacagcactttacagtttgtagatgtaaccagtagctgatcttaaggcttttttaaaaaacaaaacaaaacaacaaaaaaaaatctttataagaaagagaactgaaaagtagcgtgctattcgtcctgtaggtgctgtggtggatggacctgggcagagggcacttctctctcttacctctcttgcactttctgtctcctgtctcttctcgcccctgccgcctgccccagcttccccgactccatctgcagctctgccattgtgacatttcctgttacccagcccaagttttcatcgtctgctcaataccgtgggttcttcttcgtcctctgtcctctgcccagtgtgaggccatcaccatgtgagaagacatcttggcctgatttgctgccaccagcgtcccctccctcagtgggcccgaactcgccagccccagctttcagtggagaaagcggtcctctgaaatggtttcctcccaacccccgcatttaaagggactcaaggtgcctgccacttcctcagcgaagaagtctgtgttcctccccgtccttgccagtggcgatcatcccttcacaatcccagagtggcaggcgggaccagccccatggtctggctcctgtcacctgggtccgtgccagcacaatctgccaaagttctagagaccctgttcccttccccatcacctcacatgcttcttctgtgtgtatttctttttgtttttatggtttttggagcaatttaaactcccagttgtttattttcacaaaagaaaataaaattgcagttgcaagaccttt

SEQ ID NO: 319579 - DNA, 3055 bp, Homo sapiens
gcgccgggccgggccgggcagggcgcgggcggctaggggctccgagagcggcggccccggcccgcggccccaccatgccccagctcggcggcgggggcggcggcggcggcggcggcagcgggggaggcggcggctccagcgccggggcggccggcggaggggacgacctcggggcgaacgacgagctgatccccttccaggacgaggggggcgaggagcaggagccgagcagcgatagcgcctcggcgcagcgggacctagacgaggtcaagtcgtccctggtcaacgagtcggagaaccagagcagcagctcggactcggaggcggagaggcgcccgcagcccgtccgggacactttccagaagccgcgggactatttcgccgaagtgagaaggcctcaggacagcgcgttctttaaaggacccccgtaccctgggtaccccttcctgatgatcccggacctgagcagcccgtacctctccaacggacccctgtctcccggaggagcgcgcacctacctgcagatgaaatggcccctcctcgatgtcccctccagcgccacagtcaaggacacgaggtcaccatctccagcacacttgtctaataaagttcctgtcgttcagcacccgcatcacatgcatccgctgactcccctcatcacctacagcaatgaccacttctcccccggctcccctcccacccacctctccccagagatcgatccaaagacaggaatcccccggccccctcacccatccgagctgtcaccgtattacccactctctcccggagctgtcggacaaatcccccaccccctcggctggctcgtcccacagcaaggccagcccatgtactcccttcctcccggtggcttccggcacccttaccccgccctcgccatgaacgcctcgatgtccagcctggtctccagtcggttctctcctcacatggtggctcctgcccaccctggcctgcccacctcagggatcccccaccctgccatcgtctcccccatcgtcaagcaggaaccggcaccccccagcctgagccctgcagtgagcgtgaaatcaccagtcaccgtgaaaaaggaggaggaaaagaagccccacgtgaagaagcctctgaatgccttcatgttgtatatgaaggagatgagggccaaggtggtggctgagtgcaccctgaaggaaagtgcagccattaaccagatccttggaagaaagtggcacaacctgtctcgagaagaacaggccaagtactacgagctggcccggaaggagcggcagcttcactcgcagctctacccaacctggtcagcccgggacaactatggtaagaaaaagaagaggaagagagaaaagcagctgtcccagacacagtcacagcagcaagtccaggaggcagagggtgccctggcctccaagagcaagaagccatgtgttcagtacctgccccccgagaagccctgtgacagccctgcctcctcccacgggagcatgctggactccccggccactccctctgcagctttggcctcaccagctgcccctgctgccacccattcggagcaagcccagcccctctccctcaccaccaaaccagaaacccgggcccagctggctctccactctgccgccttcctgtcggctaaggctgcagcctcctcctctgggcagatgggcagccagcctcccctcctgtcccggcccctcccccttgggtccatgcccacagctctgctggcctctcccccgtccttccccgccacgctccatgcccaccaggccctcccggtgctacaggcccagcctctttccctggtcaccaagtctgcccactaagctccccccgacccctgcaggctgtcacatgactcattgagtagtaatgattcagaagaaaaagaaaaaggagactttattggtcaatatttgaccactctggactgttctgtaaagtggctggtaacaacagcactttacagtttgtagatgtaaccagtagctgatcttaaggcttttttaaaaaacaaaacaaaacaacaaaaaaaaatctttataagaaagagaactgaaaagtagcgtgctattcgtcctgtaggtgctgtggtggatggacctgggcagagggcacttctctctcttacctctcttgcactttctgtctcctgtctcttctcgcccctgccgcctgccccagcttccccgactccatctgcagctctgccattgtgacatttcctgttacccagcccaagttttcatcgtctgctcaataccgtgggttcttcttcgtcctctgtcctctgcccagtgtgaggccatcaccatgtgagaagacatcttggcctgatttgctgccaccagcgtcccctccctcagtgggcccgaactcgccagccccagctttcagtggagaaagcggtcctctgaaatggtttcctcccaacccccgcatttaaagggactcaaggtgcctgccacttcctcagcgaagaagtctgtgttcctccccgtccttgccagtggcgatcatcccttcacaatcccagagtggcaggcgggaccagccccatggtctggctcctgtcacctgggtccgtgccagcacaatctgccaaagttctagagaccctgttcccttccccatcacctcacatgcttcttctgtgtgtatttctttttgtttttatggtttttggagcaatttaaactcccagttgtttattttcacaaaagaaaataaaattgcagttgcaagacctttaaagagtgtttctttagtgcttttgttgaatcaaaccacctgtttgtttcactcccaaaccctgtgttagactttcgcagatatgcaaaggaagattgccacttgccacaggggaatgttaggcatgcctgacacccttagaaaacctgaacccagcttcctgtctcaaatgtgcatgggccagtcagtgtccatgactgagctgcaaagggggtaatcattttcacagctgatttaaatgaatttgccgcctggaatgacattcagcttatgcttctatcacccattt

SEQ ID NO: 319580 - DNA, 389 bp, Homo sapiens
cagcgcagatcatccctcagcagcctgtagtgtttgagatgacacagcgcagatcattccccagaagcctgtactgtttcccacacacagtgcacgtgaggggagcgatggagggtgggtgtgatcccttctcaagtcctgctgctctgctgtgtccactgctgtcatctctcagggactgttttgaggactgaatgggatgttgcctggaaaatacctggcacttacttgattccataaataacagctggtcatactctccatctccttggcaaccattcctggtcttttttgtctctttcagtctaataaagttcctgtcgttcagcacccgcatcacatgcatccgctgactcccctcatcacctacagcaatgaccacttctccc

SEQ ID NO: 319581 - DNA, 2766 bp, Homo sapiens
gcgccgggccgggccgggcagggcgcgggcggctaggggctccgagagcggcggccccggcccgcggccccaccatgccccagctcggcggcgggggcggcggcggcggcggcggcagcgggggaggcggcggctccagcgccggggcggccggcggaggggacgacctcggggcgaacgacgagctgatccccttccaggacgaggggggcgaggagcaggagccgagcagcgatagcgcctcggcgcagcgggacctagacgaggtcaagtcgtccctggtcaacgagtcggagaaccagagcagcagctcggactcggaggcggagaggcgcccgcagcccgtccgggacactttccagaagccgcgggactatttcgccgaagtgagaaggcctcaggacagcgcgttctttaaaggacccccgtaccctgggtaccccttcctgatgatcccggacctgagcagcccgtacctctccaacggacccctgtctcccggaggagcgcgcacctacctgcagatgaaatggcccctcctcgatgtcccctccagcgccacagtcaaggacacgaggtcaccatctccagcacacttgtctaataaagttcctgtcgttcagcacccgcatcacatgcatccgctgactcccctcatcacctacagcaatgaccacttctcccccggctcccctcccacccacctctccccagagatcgatccaaagacaggaatcccccggccccctcacccatccgagctgtcaccgtattacccactctctcccggagctgtcggacaaatcccccaccccctcggctggctcgtcccacagcaaggccagcccatgtactcccttcctcccggtggcttccggcacccttaccccgccctcgccatgaacgcctcgatgtccagcctggtctccagtcggttctctcctcacatggtggctcctgcccaccctggcctgcccacctcagggatcccccaccctgccatcgtctcccccatcgtcaagcaggaaccggcaccccccagcctgagccctgcagtgagcgtgaaatcaccagtcaccgtgaaaaaggaggaggaaaagaagccccacgtgaagaagcctctgaatgccttcatgttgtatatgaaggagatgagggccaaggtggtggctgagtgcaccctgaaggaaagtgcagccattaaccagatccttggaagaaagtggcacaacctgtctcgagaagaacaggccaagtactacgagctggcccggaaggagcggcagcttcactcgcagctctacccaacctggtcagcccgggacaactatggtaagaaaaagaagaggaagagagaaaagcagctgtcccagacacagtcacagcagcaagtccaggaggcagagggtgccctggcctccaagagcaagaagccatgtgttcagtacctgccccccgagaagccctgtgacagccctgcctcctcccacgggagcatgctggactccccggccactccctctgcagctttggcctcaccagctgcccctgctgccacccattcggagcaagcccagcccctctccctcaccaccaaaccagaaacccgggcccagctggctctccactctgccgccttcctgtcggctaaggctgcagcctcctcctctgggcagatgggcagccagcctcccctcctgtcccggcccctcccccttgggtccatgcccacagctctgctggcctctcccccgtccttccccgccacgctccatgcccaccaggccctcccggtgctacaggcccagcctctttccctggtcaccaagtctgcccactaagctccccccgacccctgcaggctgtcacatgactcattgagtagtaatgattcagaagaaaaagaaaaaggagactttattggtcaatatttgaccactctggactgttctgtaaagtggctggtaacaacagcactttacagtttgtagatgtaaccagtagctgatcttaaggcttttttaaaaaacaaaacaaaacaacaaaaaaaaatctttataagaaagagaactgaaaagtagcgtgctattcgtcctgtaggtgctgtggtggatggacctgggcagagggcacttctctctcttacctctcttgcactttctgtctcctgtctcttctcgcccctgccgcctgccccagcttccccgactccatctgcagctctgccattgtgacatttcctgttacccagcccaagttttcatcgtctgctcaataccgtgggttcttcttcgtcctctgtcctctgcccagtgtgaggccatcaccatgtgagaagacatcttggcctgatttgctgccaccagcgtcccctccctcagtgggcccgaactcgccagccccagctttcagtggagaaagcggtcctctgaaatggtttcctcccaacccccgcatttaaagggactcaaggtgcctgccacttcctcagcgaagaagtctgtgttcctccccgtccttgccagtggcgatcatcccttcacaatcccagagtggcaggcgggaccagccccatggtctggctcctgtcacctgggtccgtgccagcacaatctgccaaagttctagagaccctgttcccttccccatcacctcacatgcttcttctgtgtgtatttctttttgtttttatggtttttggagcaatttaaactcccagttgtttattttcacaaaagaaaataaaattgcagttgcaagaccttt

SEQ ID NO: 319582 - DNA, 1425 bp, Homo sapiens
gcgccgggccgggccgggcagggcgcgggcggctaggggctccgagagcggcggccccggcccgcggccccaccatgccccagctcggcggcgggggcggcggcggcggcggcggcagcgggggaggcggcggctccagcgccggggcggccggcggaggggacgacctcggggcgaacgacgagctgatccccttccaggacgaggggggcgaggagcaggagccgagcagcgatagcgcctcggcgcagcgggacctagacgaggtcaagtcgtccctggtcaacgagtcggagaaccagagcagcagctcggactcggaggcggagaggcgcccgcagcccgtccgggacactttccagaagccgcgggactatttcgccgaagtgagaaggcctcaggacagcgcgttctttaaaggacccccgtaccctgggtaccccttcctgatgatcccggacctgagcagcccgtacctctccaacggacccctgtctcccggaggagcgcgcacctacctgcagatgaaatggcccctcctcgatgtcccctccagcgccacagtcaaggacacgaggtcaccatctccagcacacttgtctaataaagttcctgtcgttcagcacccgcatcacatgcatccgctgactcccctcatcacctacagcaatgaccacttctcccccggctcccctcccacccacctctccccagagatcgatccaaagacaggaatcccccggccccctcacccatccgagctgtcaccgtattacccactctctcccggagctgtcggacaaatcccccaccccctcggctggctcgtcccacagcaaggccagcccatgtactcccttcctcccggtggcttccggcacccttaccccgccctcgccatgaacgcctcgatgtccagcctggtctccagtcggttctctcctcacatggtggctcctgcccaccctggcctgcccacctcagggatcccccaccctgccatcgtctcccccatcgtcaagcaggaaccggcaccccccagcctgagccctgcagtgagcgtgaaatcaccagtcaccgtgaaaaaggaggaggaaaagaagccccacgtgaagaagcctctgaatgccttcatgttgtatatgaaggagatgagggccaaggtggtggctgagtgcaccctgaaggaaagtgcagccattaaccagatccttggaagaaagtggcacaacctgtctcgagaagaacaggccaagtactacgagctggcccggaaggagcggcagcttcactcgcagctctacccaacctggtcagcccgggacaactatgtaagtgcacactctgggcagaggacgctcagaccccaggaacagcctctgcaagaggaggaagggtgaaggaaagcaactgcatttattttta

SEQ ID NO: 319583 - DNA, 421 bp, Homo sapiens
tcatcataagacaactataattccaaaactcttctgataaccacaaagtaacatggctgttaaatattaaaagtgtttaatagctaaaatatttaatatctggggcttgcagctttgtgttggcattttgagttagaatgagtgaacctcagttcagaggtgttatattgaaaggtttcaagtaaaaagcattttacacttcttttggggaatggctttcatgcctaaaacataaaattgttctgatgttttactttaactcattttctcaatgcagccaaaaagagatgcaaattatctcctctaatttctcctccagaaggacacattgtctctgcaaaatgttcctgagagggatctagagttattacagaactgaactgagcatcttggcacatgccttctctgtctctcctcctcc

SEQ ID NO: 319584 - DNA, 751 bp, Homo sapiens
tactgaattctcacaggaagtctcagacgaagacactgctaactccactttcagagagaaacactgaggctcagagctaaactaactcgcctcagagcccacatcctggacttgagcctcagggtgttgcatgccaaagcctgtcctcttcaccccagcttcctgggcattggagcggatccatagtgttagatatgcagtgggaatggcccccattccaagccacttcctgacctgatggcagcaccctgctagtcctcacatggagccctggagaagccgggttccttaacccagatttgaatcaatagcctcacacctggtatgcacatccaggccaagtgtggctgaatggggagcatctgttctggagacggccaccctcatgggctcctctgcttcctgtcccttcgggcactgatttatggcacacagcagggaagggcctgagcttgagccctgaccatcgttatcatcaccatcttcattccagtgcagtgaagaacattctgaaggtagagatgaaggtcttctttctgaatgaagctccttgcatgattcagggatcttcctcttgaaggcaccaatcattttgactttaatgcatgcactctgacttacttgtggtgatctctcctggaaatacatggaaaaatgaaaaataggctaactggggagatttcttaaataccagtttgtatggctgtgttaacctgaatgattaaatataggattgttttttaagttaaaa

SEQ ID NO: 319585 - DNA, 615 bp, Homo sapiens
tactgaattctcacaggaagtctcagacgaagacactgctaactccactttcagagagaaacactgaggctcagagctaaactaactcgcctcagagcccacatcctggacttgagcctcagggtgttgcatgccaaagcctgtcctcttcaccccagcttcctgggcattggagcggatccatagtgttagatatgcagtgggaatggcccccattccaagccacttcctgacctgatggcagcaccctgctagtcctctgcttcctgtcccttcgggcactgatttatggcacacagcagggaagggcctgagcttgagccctgaccatcgttatcatcaccatcttcattccagtgcagtgaagaacattctgaaggtagagatgaaggtcttctttctgaatgaagctccttgcatgattcagggatcttcctcttgaaggcaccaatcattttgactttaatgcatgcactctgacttacttgtggtgatctctcctggaaatacatggaaaaatgaaaaataggctaactggggagatttcttaaataccagtttgtatggctgtgttaacctgaatgattaaatataggattgttttttaagttaaaa

SEQ ID NO: 319586 - DNA, 500 bp, Homo sapiens
attccgtctaaaaaaagctaaaaagctccgactttttctctacatctgagctgtgggaaacagtcaagtatttaacaacaacaacaaaaaacaaacaaacaaaccacctcaggaaagcactcttgggatgaaatacaaataaacaacttttatattgaaaagtatgtgtaactacatactaaaataagagtttaggcttaggcctcaggagatgagtgtcagactcacagggaagtgcaaaccaaaatgcaaatttcaaagtgggtatcactaaagtacatgaccccttgttgatatagtgggtatacaagtgacaggtaataaaggctgaggagcgctggggtaagagtgccacctccttcacatcaagacagagaaagctcaaggccatgtcaagagctggctatgttgtgctcgagtttggaagacacctttttctggcgtctctaacctgagaaataccagattgctcgggcagcatgaaagaggccttttagctt

SEQ ID NO: 319587 - DNA, 2803 bp, Homo sapiens
cagtcagattaactgaaagtaaagagaggactgcgggagtttgggacctttgtgcagacgtgctcatgctcgttcgtgtagagggcgggagagaggaaaggaaggagggcattgggagctgaggccccacctttcatttcagaaaagtgcacaggcagagcgggctgagtcacaggcacaggtgaggaactcaactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggaagctgagatgatttccaagaacaagaaccctagtatttcttgaagttaatggaaacttttctttggcttttccagttgtgacccgttttccaaccagttctgcagcatattagattctagacaagcaacacccctctggagccagcacagtgctcctccatatcaccagtcatacacagcctcattattaaggtcttatttaatttcagagtgtaaattttttcaagtgctcattaggttttataaacaagaagctacatttttgcccttaagacactacttacagtgttatgacttgtatacacatatattggtatcaaaggggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgatagatttttgttgttttgttaattaatccaagatttacaatagcacaacgctaaatcacacagtaactacaaaaggttacatagatatgaaaagattggcagaggccattgcaggatgaatcacttgtcacttttcttctgtgctgggaaaaataatcaacaatgtgggtctttcatgagcagtgacggatagtttagcttactatgtttcccccccaattcaatgatctataacaacagagcaaagtctatgctcatttgcagactggaatcattaagtaatttaataaaaagattgtgaaacagcatattacaagtttgaaaattcagggctggtgaaaaaaatcaactctaaatgatgataattttgtacagttttatataaaactctgagaactagaagaaattattaactttttttcttttttaattctaattcacttgtttattttgggggaggaagactttggtatggagcaaagaaataccaaaactactttaaatggaataaaaccaactttattctttttttcccccatactggtagataaagcaaactttataagtgggctattgaaagaaaagttacaagcttaagatacagaagcatttgttcaaaggatagaaagcatctaaaagtttaggctcaagatcaatctttacagattgatattttcagtttttaatcgactggactgcagatgttttttcttttaacaaactggaattttcaaacagattatctgtatttaaatgtatagaccttgatatttttccaatactattttttaaaaaattgtatgatttacatatgaacctcagttctgaaattcattacatatctgtctcattctgccttttatactgtctaaaaaagcaaagttttaaagtgcaattttaaaactgtaaattacatctgaaggctatatatcctttaatcacattttatattttttcttcacaattctaacctttgaaaatattataactggatatttcttcaaacagatgtcctggatgatggtccataagaataatgaagaagtagttaaaaatgtatggacagtttttccggcaaaatttgtagcttatgtcttggctaaatagtcaaggggtaatatgggcctgttgtttagtgtctccttcctaaagagcacttttgtattgtaatttattttttattatgctttaaacactatgtaaataaacctttagtaataaagaattatcagttatataatttgtgtatatac

SEQ ID NO: 319588 - DNA, 672 bp, Homo sapiens
atggtaaaataaggtgtctgctttaaaactctggagttcccgaatcagaacccaaactgtattcccttacattctgaaaagtctctaagttcagaggtgtgaatattattaattagatggcaccagtttagctctgtgtaaacttcaatctactcccaagtgcatgtaattcttccaaaaatatgggggaaaaataccttacctgaagcttctgtgggatttacccacttgcttcttgtcttgttcacctgacatttggtttctgcttgttacagaaaagaagaggaaaggctcaaccaagagaaaaaggtctctgtttatttagaagacacagactaacaattttagatggtaaggttcacaaataggttgatttctttcttcagctttctgacatgtccagcccatctctaatgaggactcccagatcatcactttatggctgttaggtgtttcccatatgaaattagaggagctgggtcagggagacaaaagtcttctattagtcttatggatagctcctccttgagtgtattttgtgcaaaagattaagaagctggactctactgccattaaagctgagagaatcctaaggttatttgtggcttcggggttatatttattactactactactaataaatattcaacaagtaaataaatcttttttaaa

SEQ ID NO: 319589 - DNA, 2749 bp, Homo sapiens
cagtcagattaactgaaagtaaagagaggactgcgggagtttgggacctttgtgcagacgtgctcatgctcgttcgtgtagagggcgggagagaggaaaggaaggagggcattgggagctgaggccccacctttcatttcagaaaagtgcacaggcagagcgggctgagtcacaggcacaggtgaggaactcaactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcgctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggaagctgagatgatttccaagaacaagaaccctagtatttcttgaagttaatggaaacttttctttggcttttccagttgtgacccgttttccaaccagttctgcagcatattagattctagacaagcaacacccctctggagccagcacagtgctcctccatatcaccagtcatacacagcctcattattaaggtcttatttaatttcagagtgtaaattttttcaagtgctcattaggttttataaacaagaagctacatttttgcccttaagacactacttacagtgttatgacttgtatacacatatattggtatcaaaggggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgatagatttttgttgttttgttaattaatccaagatttacaatagcacaacgctaaatcacacagtaactacaaaaggttacatagatatgaaaagattggcagaggccattgcaggatgaatcacttgtcacttttcttctgtgctgggaaaaataatcaacaatgtgggtctttcatgagcagtgacggatagtttagcttactatgtttcccccccaattcaatgatctataacaacagagcaaagtctatgctcatttgcagactggaatcattaagtaatttaataaaaagattgtgaaacagcatattacaagtttgaaaattcagggctggtgaaaaaaatcaactctaaatgatgataattttgtacagttttatataaaactctgagaactagaagaaattattaactttttttcttttttaattctaattcacttgtttattttgggggaggaagactttggtatggagcaaagaaataccaaaactactttaaatggaataaaaccaactttattctttttttcccccatactggtagataaagcaaactttataagtgggctattgaaagaaaagttacaagcttaagatacagaagcatttgttcaaaggatagaaagcatctaaaagtttaggctcaagatcaatctttacagattgatattttcagtttttaatcgactggactgcagatgttttttcttttaacaaactggaattttcaaacagattatctgtatttaaatgtatagaccttgatatttttccaatactattttttaaaaaattgtatgatttacatatgaacctcagttctgaaattcattacatatctgtctcattctgccttttatactgtctaaaaaagcaaagttttaaagtgcaattttaaaactgtaaattacatctgaaggctatatatcctttaatcacattttatattttttcttcacaattctaacctttgaaaatattataactggatatttcttcaaacagatgtcctggatgatggtccataagaataatgaagaagtagttaaaaatgtatggacagtttttccggcaaaatttgtagcttatgtcttggctaaatagtcaaggggtaatatgggcctgttgtttagtgtctccttcctaaagagcacttttgtattgtaatttattttttattatgctttaaacactatgtaaataaacctttagtaataaagaattatcagttatataatttgtgtatatac

SEQ ID NO: 319590 - DNA, 1575 bp, Homo sapiens
cagtcagattaactgaaagtaaagagaggactgcgggagtttgggacctttgtgcagacgtgctcatgctcgttcgtgtagagggcgggagagaggaaaggaaggagggcattgggagctgaggccccacctttcatttcagaaaagtgcacaggcagagcgggctgagtcacaggcacaggtgaggaactcaactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggaagctgagatgatttccaagaacaagaaccctagtatttcttgaagttaatggaaacttttctttggcttttccagttgtgacccgttttccaaccagttctgcagcatattagattctagacaagcaacacccctctggagccagcacagtgctcctccatatcaccagtcatacacagcctcattattaaggtcttatttaatttcagagtgtaaattttttcaagtgctcattaggttttataaacaagaagctacatttttgcccttaagacactacttacagtgttatgacttgtatacacatatattggtatcaaaggggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgatgctcaaagatcttgggggtaccga

SEQ ID NO: 319591 - DNA, 1743 bp, Homo sapiens
cagtcagattaactgaaagtaaagagaggactgcgggagtttgggacctttgtgcagacgtgctcatgctcgttcgtgtagagggcgggagagaggaaaggaaggagggcattgggagctgaggccccacctttcatttcagaaaagtgcacaggcagagcgggctgagtcacaggcacaggtgaggaactcaactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcgtaaggctgggcagttctgggaaagttctaacactcttatggcgactcttggtattttgcagtgggctaaatagttgctgaacagatgtttttccctttaagtaaatcctatataaaagaattcacatttgcaggacagataaatcaggtatgaactagtaactttacaaaagctttcttaattttacaaaatatttccttatgggatttctttactatgtgggggggttgattttacaaaaatgtgctatgtaaagcttttctaaaaaatcccttatgtttaaagtgaagcatacatttgtaaaaaccactgggctaggcagtcagcagggccactatgagtcagggcttaggaaagtctgttgtgctgatagcaggtgttcattaaatgtattttaaaattgagataaaatttacccaccataaaatttacctttttcattttcacaaagttgtgcagcaatcatcactaattgcagaacgtttttaagctccctcccgtaaagaaaccccatatccctagctatcactccctattatcccctcctaccagcccccgacaactactcatctactttctgtctctatggatttgcttattctggacatttcatttaaatagaatcatacaatatgtggtcttttatgcccagcttctttcacttagcataatgctttcaaggctcatccttgttgatgtattagtatttctttcctttttatgactgcataatattccattgtatgaatataccacatattgtttgtccattcaattgatgggcatttaggttttttctgcttgttggctgttgtgactaatgctgctataaacattcatttacaa

SEQ ID NO: 319592 - DNA, 2747 bp, Homo sapiens
cagtcagattaactgaaagtaaagagaggactgcgggagtttgggacctttgtgcagacgtgctcatgctcgttcgtgtagagggcgggagagaggaaaggaaggagggcattgggagctgaggccccacctttcatttcagaaaagtgcacaggcagagcgggctgagtcacaggcacaggtgaggaactcaactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggaagctgagatgatttccaagaacaagaaccctagtatttcttgaagttaatggaaacttttctttggcttttccagttgtgacccgttttccaaccagttctgcagcatattagattctagacaagcaacacccctctggagccagcacagtgctcctccatatcaccagtcatacacagcctcattattaaggtcttatttaatttcagagtgtaaattttttcaagtgctcattaggttttataaacaagaagctacatttttgcccttaagacactacttacagtgttatgacttgtatacacatatattggtatcaaaggggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgatagatttttgttgttttgttaattaatccaagatttacaatagcacaacgctaaatcacacagtaactacaaaaggttacatagatatgaaaagattggcagaggccattgcaggatgaatcacttgtcacttttcttctgtgctgggaaaaataatcaacaatgtgggtctttcatgagcagtgacggatagtttagcttactatgtttcccccccaattcaatgatctataacaacagagcaaagtctatgctcatttgcagactggaatcattaagtaatttaataaaaagattgtgaaacagcatattacaagtttgaaaattcagggctggtgaaaaaaatcaactctaaatgatgataattttgtacagttttatataaaactctgagaactagaagaaattattaactttttttcttttttaattctaattcacttgtttattttgggggaggaagactttggtatggagcaaagaaataccaaaactactttaaatggaataaaaccaactttattctttttttcccccatactggtagataaagcaaactttataagtgggctattgaaagaaaagttacaagcttaagatacagaagcatttgttcaaaggatagaaagcatctaaaagtttaggctcaagatcaatctttacagattgatattttcagtttttaatcgactggactgcagatgttttttcttttaacaaactggaattttcaaacagattatctgtatttaaatgtatagaccttgatatttttccaatactattttttaaaaaattgtatgatttacatatgaacctcagttctgaaattcattacatatctgtctcattctgccttttatactgtctaaaaaagcaaagttttaaagtgcaattttaaaactgtaaattacatctgaaggctatatatcctttaatcacattttatattttttcttcacaattctaacctttgaaaatattataactggatatttcttcaaacagatgtcctggatgatggtccataagaataatgaagaagtagttaaaaatgtatggacagtttttccggcaaaatttgtagcttatgtcttggctaaatagtcaaggggtaatatgggcctgttgtttagtgtctccttcctaaagagcacttttgtattgtaatttattttttattatgctttaaacactatgtaaataaacctttagtaataaagaattatcagttatataatttgtgtatatac

SEQ ID NO: 319593 - DNA, 1293 bp, Homo sapiens
cagtcagattaactgaaagtaaagagaggactgcgggagtttgggacctttgtgcagacgtgctcatgctcgttcgtgtagagggcgggagagaggaaaggaaggagggcattgggagctgaggccccacctttcatttcagaaaagtgcacaggcagagcgggctgagtcacaggcacaggtgaggaactcaactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactgtacgcttctctgagatccacttcctggctctggccattggctctgcctgtgcactgatgatcataatagtaattgtagtggtcctcttccagcattaccggaaaaagcgatgggccgaaagagctcataaagtggtggagataaaatcaaaagaagaggaaaggctcaaccaagagaaaaaggtctctgtttatttagaagacacagactaacaattttagatggtaaggttcacaaataggttgatttctttcttcagctttctgacatgtccagcccatctctaatgaggactcccagatcatcactttatggctgttaggtgtttcccatatgaaattagaggagctgggtcagggagacaaaagtcttctattagtcttatggatagctcctccttgagtgtattttgtgcaaaagattaagaagctggactctactgccattaaagctgagagaatcctaaggttatttgtggcttcggggttatatttattactactactactaataaatattcaacaagtaaataaatcttttttaaa

SEQ ID NO: 319594 - DNA, 533 bp, Homo sapiens
agtcctcagtaatatcaggcaattcacctagaattcagaaagcaacaaatagaacaattcctctctcttgggacttcattttcttggatctgaatttttaagtcctgaagattctgaaatattccaaaggattaggagtttaaaattctctcttcctcatggaggaaaaccaggagatatacaaagaggtatcctgctagaggatcccaggctaacgatggattagggaagaacagatgatgtgtccaagcgaggaggacataagagaagcaaggtgccaaataaagaatgagaggtcaaatgtaatacaatttgctgactgtaagggggagagtttttttccccaaaatgccaaagtacataaagataaaggtgaaagtttcctctcaccagttccagtgttaacagtgagagttcttgggcaagccctccccaaatgaccgaaatggccctcctgctactccaggactacattttaccagcatagtgacaaagtaaaaagcaaatgattagttcaagccagtgatgtgaag

SEQ ID NO: 319595 - DNA, 162 bp, Homo sapiens
cacaggaaattaaaaacatgaaacatatctaggtgctaaagctgtatccaaaattcttagcaagcagggtgacctgggattccttggcaaatgactttaaaaaaaattctcatcagacatttttagttcaattcaataaaaagagggtgtgtgtatgggagt

SEQ ID NO: 319596 - DNA, 583 bp, Homo sapiens
atcctttgctggagctggcacacggaggaagtcctggagggagggtagacaccgtggaggtaagggcttgggacctgtgtcaggagagctaggtccatctccctcccagtctctcactaggcttatgatctttagcagtgaaaataatctctctaaggtggggaaaggaccccggtccctgctgtgctcaataaattatgaggatcaaaataaattatcagtgaatgtgaatgggaaaactaagaaattgttaaaattctcgaatacattacattttcatccacagaaaagtataggctagggatcatgggggaatagttagtaatgacagggatagttgaacttaaaaaaaaagtttgtgaggctgacaaagaagaaacggacacatttcctgatcttggagggttcatagggtagaagatggtagatgacagctgggtgtggtggcactcgcctgtagtcccagctactcaagaggctgtggtgggaggattgcttgagcccaggcattcaaggctgcagtgagctataatcatgccactgcattccaactgagtgacacagcaagactcctctcttaaaa

SEQ ID NO: 319597 - DNA, 640 bp, Homo sapiens
atcctttgctggagctggcacacggaggaagtcctggagggagggtagacaccgtggaggtaagggcttgggacctgtgtcaggagagctaggtccatctccctcccagtctctcactaggcttatgatctttagcagtgaaaataatctctctaaggtggggaaaggaccccggtccctgctgtgctcaataaattatgaggatcaaaataaattatcaaatgagtactatcaggaaggttcaaaccacgggctaaatcagtagttctaaaacttgactacacatcggaatcacctagggaactttaaaagatactaagatttaggtccaacctgggtttactgatttaacaacctaggttgtggctgtggcctgggaacatggatattaaaaactctccaggtggttctacgcagtggctaggtttgatgacctctgcctagatgtcccaacgactaagagatgtgcgttggggacaaggcaattctcttagtagaaagaggctttcgggacagcattcttattattgagaattgagaattcatatgccacacaatttatccttttaaagtgtgcagctcagtggcttctagcgtaatcacaaggttgtgccaccgtcaccactgtctaccctggaag

SEQ ID NO: 319598 - DNA, 399 bp, Homo sapiens
gacttacgaatctcgaacctcggtaccccccccgactagcccgacagcccagactagcccgacagctccccgactagcccgacagctccccgactagcccgacagctccccgactagcccgacagctccccgactagcccgacagctccccgactagcccgacagctccccgactagcccgacggtgtgtacgcatcacggacactggcctcagctatctgtccaccatgtcgtccctccgcagcctctacctgcgatggtgctgccaggtgcaagacttcgggctgaagcacctcctggccctggggagtttgcgcctcctgtctctggcaggctgcccgctgctcaccaccaccgggctgtcgggctagtcgaggggatcctcaagtagccccgaaa

SEQ ID NO: 319599 - DNA, 637 bp, Homo sapiens
ccccgactagttcgacagcattagggacaatataatgtgtgctgtagtggacgcttgtaccaagtgccacagaaaggagagagctgactgcctggaagtcagaggcccctcagaggagggaacatttcagcttaatcttcaaggatgaggaataattcactgggcagaaaaatgaggggataagaatccaacctgtcgggctagtcggggccccgactagcccgacggtgtgtacgcatcacggacactggcctcagctatctgtccaccatgtcgtccctccgcagcctctacctgcgatggtgctgccaggtgcaagacttcgggctgaagcacctcctggccctggggagtttgcgcctcctgtctctggcaggctgcccgctgctcaccaccaccgggctgtcgggcctggtgcagctgcaggagctggaggagctggagctgaccaactgccccggggccacccccgagctcttcaagtatttctcgcagcacctgccccgctgcctcgtcattgagtagcgcgaggcccccgccccggtcgcgggaacccggccatgacctgggcgggggcgcggggcgccgccgagccccctcttcccgccttgcgctcgggggagcccccgcgcccccg

SEQ ID NO: 319600 - DNA, 1053 bp, Homo sapiens
agatgggctcttctggtatttctcggcctgcgagaagtgtgtgctggcccaggtgtgcaaggcctggcggcgcgtgctgtaccagcccaagttctgggcaggcctcacgccggtgctgcatgccaaggagctctacaacgtgctgcctggtggcgagaaggagttcgtgaacctgcagggttttgccgccagaggcttcgagggcttctgcctggttggcgtctccgacctggacatctgtgagttcattgacaactatgcgctctccaagaagggtgtcaaagccatgagcctcaagcgctccaccatcacggacgcaggcctcgaggttatgcttgaacagatgcagggcgtggtgcgtctggagctgtcgggctgcaacgacttcaccgaggccgggctgtggtccagcctgagcgcgcgcatcacctcgctgagcgtgagtgactgcatcaacgtggccgacgacgccatcgcggccatctcgcagctgctgcccaacctggcggagctgagcctgcaggcctaccacgtgacggacacggcgctggcctacttcacggcgcgccagggccacagcacgcacacgctgcgcctgctctcctgctgggagatcaccaaccacggcgtggtcaacgtggtgcacagcctgcccaacctcaccgcgctcagcctctcgggctgctccaaggtcaccgacgacggcgtggagctcgtggccgagaacctgcgcaagctgcgcagccttgacctctcgtggtgcccacgcatcaccgacatggcgctggagtacgtggcctgcgacctgcaccgcctagaggagctcgtgctcgacagggtgtgtacgcatcacggacactggcctcagctatctgtccaccatgtcgtccctccgcagcctctacctgcgatggtgctgccaggtgcaagacttcgggctgaagcacctcctggccctggggagtttgcgcctcctgtctctggcaggctgcccgctgctcaccaccaccgggctgtcgggctagtcgaggggatcctcaagtagccccgaaa

SEQ ID NO: 319601 - DNA, 1447 bp, Homo sapiens
agatgggctcttctggtatttctcggcctgcgagaagtgtgtgctggcccaggtgtgcaaggcctggcggcgcgtgctgtaccagcccaagttctgggcaggcctcacgccggtgctgcatgccaaggagctctacaacgtgctgcctggtggcgagaaggagttcgtgaacctgcagggttttgccgccagaggcttcgagggcttctgcctggttggcgtctccgacctggacatctgtgagttcattgacaactatgcgctctccaagaagggtgtcaaagccatgagcctcaagcgctccaccatcacggacgcaggcctcgaggttatgcttgaacagatgcagggcgtggtgcgtctggagctgtcgggctgcaacgacttcaccgaggccgggctgtggtccagcctgagcgcgcgcatcacctcgctgagcgtgagtgactgcatcaacgtggccgacgacgccatcgcggccatctcgcagctgctgcccaacctggcggagctgagcctgcaggcctaccacgtgacggacacggcgctggcctacttcacggcgcgccagggccacagcacgcacacgctgcgcctgctctcctgctgggagatcaccaaccacggcgtggtcaacgtggtgcacagcctgcccaacctcaccgcgctcagcctctcgggctgctccaaggtcaccgacgacggcgtggagctcgtggccgagaacctgcgcaagctgcgcagccttgacctctcgtggtgcccacgcatcaccgacatggcgctggagtacgtggcctgcgacctgcaccgcctagaggagctcgtgctcgacaggtgcgcgcccccgggccgcgccgggcggggctgggccgggcggggctgcacggggcggggcggggcggggctgcacggggccgggggcgggggcttccggcggggctggggctgtggcgcggcgggcagagccctcggagcctggggagtgggaaccgcagaaccgcagcacgggttggctggacccccgtccttcccgggtgtgtacgcatcacggacactggcctcagctatctgtccaccatgtcgtccctccgcagcctctacctgcgatggtgctgccaggtgcaagacttcgggctgaagcacctcctggccctggggagtttgcgcctcctgtctctggcaggctgcccgctgctcaccaccaccgggctgtcgggcctggtgcagctgcaggagctggaggagctggagctgaccaactgccccggggccacccccgagctcttcaagtatttctcgcagcacctgccccgctgcctcgtcattgagtagcgcgaggcccccgccccggtcgcgggaacccggccatgacctgggcgggggcgcggggcgccgccgagccccctcttcccgccttgcgctcgggggagcccccgcgcccccg

SEQ ID NO: 319602 - DNA, 404 bp, Homo sapiens
gccgctggccacggacgagaagatcctcagatgggctcttctggtatttctcggcctgcgagaagtgtgtgctggcccaggtgtgcaaggcctggcggcgcgtgctgtaccagcccaagttctgggcaggcctcacgccggtgctgcatgccaaggagctctacaacgtgctgcctggtggcgagaaggagttcgtgaacctgcagggttttgccgccagaggcttcgagggcttctgcctggttggcgtctccgacctggacatctgtgagttcattgacaactatgcgctctccaagaagggtgtcaaagccatgagcctcaagcgctccaccatcacggacgcaggcctcgaggtgtgcaccaggctcgggggggacagggctggggggcaggggcgggca

SEQ ID NO: 319603 - DNA, 1248 bp, Homo sapiens
agatgggctcttctggtatttctcggcctgcgagaagtgtgtgctggcccaggtgtgcaaggcctggcggcgcgtgctgtaccagcccaagttctgggcaggcctcacgccggtgctgcatgccaaggagctctacaacgtgctgcctggtggcgagaaggagttcgtgaacctgcagggttttgccgccagaggcttcgagggcttctgcctggttggcgtctccgacctggacatctgtgagttcattgacaactatgcgctctccaagaagggtgtcaaagccatgagcctcaagcgctccaccatcacggacgcaggcctcgaggttatgcttgaacagatgcagggcgtggtgcgtctggagctgtcgggctgcaacgacttcaccgaggccgggctgtggtccagcctgagcgcgcgcatcacctcgctgagcgtgagtgactgcatcaacgtggccgacgacgccatcgcggccatctcgcagctgctgcccaacctggcggagctgagcctgcaggcctaccacgtgacggacacggcgctggcctacttcacggcgcgccagggccacagcacgcacacgctgcgcctgctctcctgctgggagatcaccaaccacggcgtggtcaacgtggtgcacagcctgcccaacctcaccgcgctcagcctctcgggctgctccaaggtcaccgacgacggcgtggagctcgtggccgagaacctgcgcaagctgcgcagccttgacctctcgtggtgcccacgcatcaccgacatggcgctggagtacgtggcctgcgacctgcaccgcctagaggagctcgtgctcgacagggtgtgtacgcatcacggacactggcctcagctatctgtccaccatgtcgtccctccgcagcctctacctgcgatggtgctgccaggtgcaagacttcgggctgaagcacctcctggccctggggagtttgcgcctcctgtctctggcaggctgcccgctgctcaccaccaccgggctgtcgggcctggtgcagctgcaggagctggaggagctggagctgaccaactgccccggggccacccccgagctcttcaagtatttctcgcagcacctgccccgctgcctcgtcattgagtagcgcgaggcccccgccccggtcgcgggaacccggccatgacctgggcgggggcgcggggcgccgccgagccccctcttcccgccttgcgctcgggggagcccccgcgcccccg

SEQ ID NO: 319604 - DNA, 261 bp, Homo sapiens
gacttacgaatctcgaacctcggtaccccccccgactagcccgacggtgtgtacgcatcacggacactggcctcagctatctgtccaccatgtcgtccctccgcagcctctacctgcgatggtgctgccaggtgcaagacttcgggctgaagcacctcctggccctggggagtttgcgcctcctgtctctggcaggctgcccgctgctcaccaccaccgggctgtcgggctagtcgaggggatcctcaagtagccccgaaa

SEQ ID NO: 319605 - DNA, 1585 bp, Homo sapiens
agatgggctcttctggtatttctcggcctgcgagaagtgtgtgctggcccaggtgtgcaaggcctggcggcgcgtgctgtaccagcccaagttctgggcaggcctcacgccggtgctgcatgccaaggagctctacaacgtgctgcctggtggcgagaaggagttcgtgaacctgcagggttttgccgccagaggcttcgagggcttctgcctggttggcgtctccgacctggacatctgtgagttcattgacaactatgcgctctccaagaagggtgtcaaagccatgagcctcaagcgctccaccatcacggacgcaggcctcgaggttatgcttgaacagatgcagggcgtggtgcgtctggagctgtcgggctgcaacgacttcaccgaggccgggctgtggtccagcctgagcgcgcgcatcacctcgctgagcgtgagtgactgcatcaacgtggccgacgacgccatcgcggccatctcgcagctgctgcccaacctggcggagctgagcctgcaggcctaccacgtgacggacacggcgctggcctacttcacggcgcgccagggccacagcacgcacacgctgcgcctgctctcctgctgggagatcaccaaccacggcgtggtcaacgtggtgcacagcctgcccaacctcaccgcgctcagcctctcgggctgctccaaggtcaccgacgacggcgtggagctcgtggccgagaacctgcgcaagctgcgcagccttgacctctcgtggtgcccacgcatcaccgacatggcgctggagtacgtggcctgcgacctgcaccgcctagaggagctcgtgctcgacaggtgcgcgcccccgggccgcgccgggcggggctgggccgggcggggctgcacggggcggggcggggcggggctgcacggggccgggggcgggggcttccggcggggctggggctgtggcgcggcgggcagagccctcggagcctggggagtgggaaccgcagaaccgcagcacgggttggctggacccccgtccttcccggtgggtgggagcgaggaggggccagcggctgctccgggtggggcaggaagggattcacgccaggggcactcccaggaagacgagggatggccggggccaggtgatttgaaggtgggggtcccctctggtgcaaccacaggtgtgtacgcatcacggacactggcctcagctatctgtccaccatgtcgtccctccgcagcctctacctgcgatggtgctgccaggtgcaagacttcgggctgaagcacctcctggccctggggagtttgcgcctcctgtctctggcaggctgcccgctgctcaccaccaccgggctgtcgggcctggtgcagctgcaggagctggaggagctggagctgaccaactgccccggggccacccccgagctcttcaagtatttctcgcagcacctgccccgctgcctcgtcattgagtagcgcgaggcccccgccccggtcgcgggaacccggccatgacctgggcgggggcgcggggcgccgccgagccccctcttcccgccttgcgctcgggggagcccccgcgcccccg

SEQ ID NO: 319606 - DNA, 1252 bp, Homo sapiens
agatgggctcttctggtatttctcggcctgcgagaagtgtgtgctggcccaggtgtgcaaggcctggcggcgcgtgctgtaccagcccaagttctgggcaggcctcacgccggtgctgcatgccaaggagctctacaacgtgctgcctggtggcgagaaggagttcgtgaacctgcagggttttgccgccagaggcttcgagggcttctgcctggttggcgtctccgacctggacatctgtgagttcattgacaactatgcgctctccaagaagggtgtcaaagccatgagcctcaagcgctccaccatcacggacgcaggcctcgaggttatgcttgaacagatgcagggcgtggtgcgtctggagctgtcgggctgcaacgacttcaccgaggccgggctgtggtccagcctgagcgcgcgcatcacctcgctgagcgtgagtgactgcatcaacgtggccgacgacgccatcgcggccatctcgcagctgctgcccaacctggcggagctgagcctgcaggcctaccacgtgacggacacggcgctggcctacttcacggcgcgccagggccacagcacgcacacgctgcgcctgctctcctgctgggagatcaccaaccacggcgtggtcaacgtggtgcacagcctgcccaacctcaccgcgctcagcctctcgggctgctccaaggtcaccgacgacggcgtggagctcgtggccgagaacctgcgcaagctgcgcagccttgacctctcgtggtgcccacgcatcaccgacatggcgctggagtacgtggcctgcgacctgcaccgcctagaggagctcgtgctcgacaggtgcgcgcccccgggccgcgccgggcggggctgggccgggcggggctgcacggggcggggcggggcggggctgcacggggccgggggcgggggcttccggcggggctggggctgtggcgcggcgggcagagccctcggagcctggggagtgggaaccgcagaaccgcagcacgggttggctggacccccgtccttcccgggtgtgtacgcatcacggacactggcctcagctatctgtccaccatgtcgtccctccgcagcctctacctgcgatggtgctgccaggtgcaagacttcgggctgaagcacctcctggccctggggagtttgcgcctcctgtctctggcaggctgcccgctgctcaccaccaccgggctgtcgggctagtcgaggggatcctcaagtagccccgaaa

SEQ ID NO: 319607 - DNA, 139 bp, Homo sapiens
taaagtacttcagtactagaagtctagagagtgaggttgatgatacattgtaaatcaaaagtggtttctcacacacaaaatgaaaggtcttcgttaaaaatttcatcactagggcccagccctgttccctccacctcac

SEQ ID NO: 319608 - DNA, 689 bp, Homo sapiens
tcgcccaaagggggttcgcccaaaggctgagcactgatctgctttggagaacctgatcctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcagaaatatcctcctgtgacaccttccccaccctgccagtcaaagtatccaccgaagagcaagtaacagcttcagaattcatcaggaccaagaaaggataaggatatttggctcacctcgttccacagctccaccttcatcttctcatcaaagcctaccatggatacacagggagcttctttctccttagccagtaatctgcccatgatgatccctgacagcaaaaagtttcttttctgaggctgccatactgccactgtccaggtggagactgagcaaaggaagtcctgggctgtgccagctcccagagcttcggaagaaagagcagcagctctctccctgggaaccatcagagaattctgttgatgtgttctgtgtctgtctgtcacctggtcacgagcttctaccacctttgcaattgtcacttatctttcactccctgaataaagtatctatgcatat

SEQ ID NO: 319609 - DNA, 433 bp, Homo sapiens
tagaggatccccctgtatcccggggaagagcaagtaacagcttcagaattcatcaggaccaagaaaggataaggatatttggctcacctcgttccacagctccaccttcatcttctcatcaaagcctaccatggatacacagggagcttctttctccttagccagtaatctgcccatgatgatccctgacagcaaaaagtttcttttctgaggctgccatactgccactgtccaggtggagactgagcaaaggaagtcctgggctgtgccagctcccagagcttcggaagaaagagcagcagctctctccctgggaaccatcagagaattctgttgatgtgttctgtgtctgtctgtcacctggtcacgagcttctaccacctttgcaattgtcacttatctttcactccctgaataaagtatctatgcatat

SEQ ID NO: 319610 - DNA, 789 bp, Homo sapiens
aattcctagggctgatgaaacaacttgctaaagtggaaaggagaagacaggaagtcatgaaaagagagctaagagtttaaataaatttttggagattggagaaataatatgccatggtattacataagctttggcttctctctctggaggagtccattcctgtgaacactgtcatatcatttctttcagattctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcaaaaatgtcctcctgtgacaccttccccaccctgccagccaaagtgtccacccaagagcaagtaacagctatcagaattcatcaggagcatgaaaggataaggataattggctcaccttgttccacagcttcacctgcatcttctcatcaaagcctaccatggatacacagttagcttctttcctcttagccagtgatctgcccatgatgatccctgatagcaaaaggtttcctttctgaggctgccatattgccactgtccaggtggagactgagaaaggaagtcctcagcagtgtcagttcccagagctttggaagaaggaccagcagctctgtccctgggaaccatcaaaaaatgctgttgatgttttctgtgtctgtctgtcacctgggcatgggcttctaacacctgtgcaattgtcacttt

SEQ ID NO: 319611 - DNA, 316 bp, Homo sapiens
aattcctagggctgatgaaacaacttgctaaagtggaaaggagaagacaggaagtcatgaaaagagagctaagagtttaaataaatttttggagattggagaaataatatgccatggtattacataagctttggcttctctctctggaggagtccattcctgtgaacactgtcatatcatttctttcagattctgagactccagcaggatgtcttatcaacagcagcagtgcaagcagccctgccagccacctcctgtgtgccccacgccaaagtgcccagagcaatacccgcaacactcaccccacgagagatcg

SEQ ID NO: 319612 - DNA, 748 bp, Homo sapiens
actctagaggataccctactggctgaccactactggctgacccactactggctgacccactactggactcttaaacccctggtacctgagcactgatctgccttggagaacctgatcctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcagaaatatcctcctgtgacaccttccccaccctgccagtcaaagtatccaccgaagagcaagtaacagcttcagaattcatcaggaccaagaaaggataaggatatttggctcacctcgttccacagctccaccttcatcttctcatcaaagcctaccatggatacacagggagcttctttctccttagccagtaatctgcccatgatgatccctgacagcaaaaagtttcttttctgaggctgccatactgccactgtccaggtggagactgagcaaaggaagtcctgggctgtgccagctcccagagcttcggaagaaagagcagcagctctctccctgggaaccatcagagaattctgttgatgtgttctgtgtctgtctgtcacctggtcacgagcttctaccacctttgcaattgtcacttatctttcactccctgaataaagtatctatgcatat

SEQ ID NO: 319613 - DNA, 892 bp, Homo sapiens
ggaaataagatgcttgattctttataacagagataatttatttggaaaaattgtatgagaaaacacaggatttcctagggacaatgaagcaatttgttaaagtggaagggagaaaccagaaagtcttgaaaaggtaattaagaatttaaataatttcttggagattggagaaataatatgccatggtattacacaagctttggcttctctctctggaggattcccttcccacgaacactgttgtatcatttctttcagatcctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcagaaatatcctcctgtgacaccttccccaccctgccagtcaaagtatccaccgaagagcaagtaacagcttcagaattcatcaggaccaagaaaggataaggatatttggctcacctcgttccacagctccaccttcatcttctcatcaaagcctaccatggatacacagggagcttctttctccttagccagtaatctgcccatgatgatccctgacagcaaaaagtttcttttctgaggctgccatactgccactgtccaggtggagactgagcaaaggaagtcctgggctgtgccagctcccagagcttcggaagaaagagcagcagctctctccctgggaaccatcagagaattctgttgatgtgttctgtgtctgtctgtcacctggtcacgagcttctaccacctttgcaattgtcacttatctttcactccctgaataaagtatctatgcatat

SEQ ID NO: 319614 - DNA, 892 bp, Homo sapiens
  misc_feature (752)..(752): n is a, c, g, or t
  misc_feature (758)..(758): n is a, c, g, or t
  misc_feature (761)..(761): n is a, c, g, or t
  misc_feature (773)..(773): n is a, c, g, or t
  misc_feature (776)..(776): n is a, c, g, or t
actctagaggataccctactggctgaccactactggctgacccactactggctgacccactactggactcttaaacccctggtacctgagcactgatctgccttggagaacctgatcctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcagaaatatcctcctgtgacaccttccccaccctgccagtcaaagtatccaccgaagagcaagtaacagcttcagaattcatcaggaccaagaaaggataaggatatttggctcacctcgttccacagctccaccttcatcttctcatcaaagcctaccatggatacacagggagcttctttctccttagccagtaatctgcccatgatgatccctgacagcaaaaagtttcttttctgaggctgccatactgccactgtccaggtggagactgagcaaaggaagtcctgggctgtgccagctcccagagcttcggaagaaagagcagcagctctctccctgggaaccatcagagaattctgttgatgtgttctgtgtctgtctgtcacctggtcacgagcttctaccacctttgcaattgtcacttatctttcactccctgaataaagtatctatgcatattaanaaaaanaancaatggccccgntgncctaagcgtggaagcttgaggccgccttcctttagtgggggttcatttatgatccttgttacttgactcggtgagccacgagcgttcggttgtgggcagcggcatcagctcactta

SEQ ID NO: 319615 - DNA, 639 bp, Homo sapiens
tgtatcggggaggatatggtggtggcctgtgtactggcttgggtggtggctttggtggtggctttgctggtggtgatgggcttctggtgggcagtgagaaggtgaccatgcagaacctcaatgaccgcctggcctcctacctggacaagggtcacttatctttcactccccgggatctccccgggatacagagtgacaccttccccaccctgccagtcaaagtatccaccgaagagcaagtaacagcttcagaattcatcaggaccaagaaaggataaggatatttggctcacctcgttccacagctccaccttcatcttctcatcaaagcctaccatggatacacagggagcttctttctccttagccagtaatctgcccatgatgatccctgacagcaaaaagtttcttttctgaggctgccatactgccactgtccaggtggagactgagcaaaggaagtcctgggctgtgccagctcccagagcttcggaagaaagagcagcagctctctccctgggaaccatcagagaattctgttgatgtgttctgtgtctgtctgtcacctggtcacgagcttctaccacctttgcaattgtcacttatctttcactccctgaataaagtatctatgcatat

SEQ ID NO: 319616 - DNA, 715 bp, Homo sapiens
taccctaggcatcaccagatgctggacgcctcttcccatctgttctgtgtcttaatgtctgtagacctgtaatcagtacattctcaccccaagccatagtctctctcttattgtatcctaaaaatacgtactataaagctttggttcacacacactctgaagaatcctgtaagcccctgaattaagcagaaagtcttcatggcttttctggtcttcggctgctcagggttcatctgaagattcggatgaaaagaaatgcatgtttcctgccgaacccccttgggccgaacccgttcggccaaaggacaagagcaagtaacagcttcagaattcatcaggaccaagaaaggataaggatatttggctcacctcgttccacagctccaccttcatcttctcatcaaagcctaccatggatacacagggagcttctttctccttagccagtaatctgcccatgatgatccctgacagcaaaaagtttcttttctgaggctgccatactgccactgtccaggtggagactgagcaaaggaagtcctgggctgtgccagctcccagagcttcggaagaaagagcagcagctctctccctgggaaccatcagagaattctgttgatgtgttctgtgtctgtctgtcacctggtcacgagcttctaccacctttgcaattgtcacttatctttcactccctgaataaagtatctatgcatat

SEQ ID NO: 319617 - DNA, 813 bp, Homo sapiens
aattcctagggctgatgaaacaacttgctaaagtggaaaggagaagacaggaagtcatgaaaagagagctaagagtttaaataaatttttggagattggagaaataatatgccatggtattacataagctttggcttctctctctggaggagtccattcctgtgaacactgtcatatcatttctttcagattctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcaaaaatgtcctcctgtgacaccttccccaccctgccagccaaagtgtccacccaagagcaagtaacagctatcagaattcatcaggagcatgaaaggataaggataattggctcaccttgttccacagcttcacctgcatcttctcatcaaagcctaccatggatacacagttagcttctttcctcttagccagtgatctgcccatgatgatccctgatagcaagaatggcatatcagtatttaaaaaagcaaattaacctgacagccattgcaaaccatgtaatacccgaccgttgatacatcctgatatgccattcttgctgcagcaagaatggcatatcactgaaggagccacgaagttatataacacacggtaaacatccacctggctcaaggggcaaatgcagtacgtacagcattggcagaggtgcgtcagacgtggcagaacta

SEQ ID NO: 319618 - DNA, 1052 bp, Homo sapiens
actctagaggataccctactggctgaccactactggctgacccactactggctgacccactactggactcttaaacccctggtacctgagcactgatctgccttggagaacctgatcctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcagaaatatcctcctgtgacaccttccccaccctgccagtcaaagtatccaccgaagagcaagtaacagcttcagaattcatcaggaccaagaaaggataaggatatttggctcacctcgttccacagctccaccttcatcttctcatcaaagcctaccatggatacacagggagcttctttctccttagccagtaatctgcccatgatgatccctgacagcaaaaagtttcttttctgaggctgccatactgccactgtccaggtggagactgagcaaaggaagtcctgggctgtgccagctcccagagcttcggaagaaagagcagcagctctctccctgggaaccatcagagaattctgttgatgtgttctgtgtctgtctgtcacctggtcacgagcttctaccacctttgcaattgtcacttatctttcactccctgaataaagtatctatgcatatatatttgtgaatggatcttttgtttattttcaaatctgctttattagcaatagtatgtaatcttttggatttatttcaatctttctttgattcacagcaggatctcacaattggagtcataccaaagattatttctgtatcattttaaaccccttttattttccctaattagcatttgattgatttgaggaggatattattcaacttctctgaattgacaacttctctttactgcaaagtgagcaaaataacatttacattacaaactagtctaaggcataaaatttgattactatctgatatt

SEQ ID NO: 319619 - DNA, 796 bp, Homo sapiens
gtatagcttttgtttgggtttttcttctcacctttaaaaaaatgagccatttctatttcattttctctgtaactgtctacttaacccttctgaggcttagtctgtacaatggaggcagtccctccttccctcagaagattacagtaagaattggatgaaataaagcctttagctcagtgcctgacacagaagaacatgcagtgaaggaaagctgctattgctccaacaaagatgtaggccattaaatttttaaaaccattttatacatgcacacatacatacaaggactcctctctcctgcaaaaattgttaccttaagtgtggttctctggttctaaggagggaagtgctaagtaagaaagacagggaggtggatattgtggttccccatcagacagaaaacacgggcacctgtttggtaatctttttcttacagtgttattgctaaattcagacagtcttcctaacccacacctgcttttaaaaagcttagctctaacatgaaactgtatgctttttgcttcttggtgttttgtataaaaaaaatcattataaccctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttca

SEQ ID NO: 319620 - DNA, 759 bp, Homo sapiens
cctgtgttctgatgctaatacataaatccagttaaagtaatttttctcctgccatgtgctgtttacttcccaattcaggtttcagacctacttcctgttttttctgttgaataaggttctgagaaacattttccttttgttaaatgcaaaatggctacttggtgcttctgctgctttcacacagtttttttcctccttctagagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcgtcagagttcccaggagcccaggtctgtttggttcagcaatagtaaattaagggtggaaaaagatgcctttttaatatggttcctagaagcaagcaagcaacttttcattccagtttgaagaggaggggagcaaaatcacccctggttgaaaactgtgggtctaggttgatggttctcagacttgagcatgtgtcagaatcatttggagaggctgttgaaacacagatttctgggcctactaccagagttcagattcagtagatgtgggatgggacccaagaatttacctttccagcaagtttcctggttgatcctgtaggtctgagaacctccttttgagaaccactggtct

SEQ ID NO: 319621 - DNA, 829 bp, Homo sapiens
cccggaagaggagcggcgaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtggggtgagtgccaacggggcctgggtctctgagcctccgaggtcggccttggaggtcgggcggagccgcgcagaaacagggcttctcagaggtccccgggaggcgctgctgtccgcgctggccccttggcgagaagtgtcggacgtctgagtggaacccggttcgtcaccgctgctctttccactcggctggcctctgcgcctttctctcatcccggtaggaccagccctaacagcttcttgctaatcccgctttgtctgacacctttctccgagccttcttcctcgttccaacttttagccccttctcttctggcgactgttgttttgcaatcaaagatacttgaccttacccactatgacaacactcttcctctttcttctgaacttcttgaagacgcgtgatgtctgcctttacccactttcgaaacgccgtgtagtctagaaaccacacgactgtactgcaactcctctcagatttgcctttttgaatcttcattatctactctgcagccttccacgcattgaacacgcccttct

SEQ ID NO: 319622 - DNA, 645 bp, Homo sapiens
cactgtggccttgacctgtcatgctcagtgtcccgagtagctggaactacaggcatgtaccaccacacccggctaatttttatattcttggtagggacaggatttgccaagttgctcaggctggtcttcaactactgggatcaggccttggcctcccatcttggcctctgaaagtgctggaattacagctgtgattccacacccagcccagtattaaatatcttataacaactaatatggttaggctttgtgtccccgctcaaatctcatcttgaattgtaatccccataagctaatcaagggagagaccaggtggaggtaattgaatcatgggggcggttcccccattctgttctcctgatagtgagttcgttctcatgagatcctttggttttataaggggctcttccctgctattcactcggcacggctccttcctgacaccttaagaagaaggtgccttgcttccccttcaccttccaccatgaatgtaagtttcctgaggccttcccagccatgctgaactgtaagtcaattaaacctctttcctttataaattacccagtcccgggcaattcattatagcattatgaaaattgactaatgcaacaactttatgagggaggcagataacagatattgtca

SEQ ID NO: 319623 - DNA, 2737 bp, Homo sapiens
cccggaagaggagcggcgaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtggggtgagtgccaacggggcctgggtctctgagcctccgaggtcggccttggaggtcgggcggagccgcgcagaaacagggcttctcagaggtccccgggaggcgctgctgtccgcgctggccccttggcgagaagtgtcggacgtctgagtggaacccggttcgtcaccgctgctctttccactcggctggcctctgcgcctttctctcatcccgagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcgtcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttca

SEQ ID NO: 319624 - DNA, 2438 bp, Homo sapiens
ttcgttaaggaaatatttcaagagggactgtggcaccaagacagtgaatgcctgcccctgagccccgatgagaaggaattaagggccctgtgactctgtatgtgaccagaagccacatcaggctccgccaggcctggcaactgtccctggtgttctgttcttcacctcctgcggctcctgactcttcagttctcagttggaattgagagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcgtcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttca

SEQ ID NO: 319625 - DNA, 2757 bp, Homo sapiens
cactgtggccttgacctgtcatgctcagtgtcccgagtagctggaactacaggcatgtaccaccacacccggctaatttttatattcttggtagggacaggatttgccaagttgctcaggctggtcttcaactactgggatcaggccttggcctcccatcttggcctctgaaagtgctggaattacagctgtgattccacacccagcccagtattaaatatcttataacaactaatatggttaggctttgtgtccccgctcaaatctcatcttgaattgtaatccccataagctaatcaagggagagaccaggtggaggtaattgaatcatgggggcggttcccccattctgttctcctgatagtgagttcgttctcatgagatcctttggttttataaggggctcttccctgctattcactcggcacggctccttcctgacaccttaagaagaaggtgccttgcttccccttcaccttccaccatgaatgtaagtttcctgaggccttcccagccatgctgaactagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcgtcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttca

SEQ ID NO: 319626 - DNA, 3226 bp, Homo sapiens
tttctcctaggttcagttaggtcgtgtttcctagcagtgtcactattcaagggttgagtccacgtcttgctctctggagaatgtcaatgtaatgtatttttcccatcgtacagagtctttgttgatttgcaaaatgttggatttggggttcatacccatattttttgttgtcatgggcatttaggtcatcagtctgttctcttatttgcttgttcttttgttaattcattcccatggctatatgccagacacagcatgatgcagaaggaatacgacagaggatgacacaggccctgccctcagctcacagtttactgccagagatagacacttggaaaaagtaattgcaggccgggcatggtggctcacgcctgtaatcccagcactttgggaggctaaggcaggcagatcacctgaggtcaggagtttaagaccagcctggccaacatggtgaaactccgtctctactgaaaatacaaaaattagccaggcgtggtggcgggtacctgtaatcccagctactcgggaggctgaggcaggagaatcgcttgaacctgggaggcagaggttgcagtgagctgaggtcgcgccattgcgctccaacctgggcaacagagtgaaactccatctcagaagaaaaaaaaaaaaaaaaaaggaaaaaagaaaaaggaattgcaaaatcatgtgcctcagtcctgtattagggtacagtggtggccccagaaaggaggtaatcaagtctgcttaggggtggtaggattaggaaaggcttcatgtttagggaggaactagcacttgaacttgggtctttaaacagtcattcctctaaagcaactcacatagaagcaactggagcagctagatagtctgatcctttggatcaggtgcccagaaaccactgatgggcagcagggaagaggagatgcagtgagcttggctgttgggaagaaattcagcctgcttaagttccaactgaatgaaagatgctcagggcaatgctgtgaggaagaatgtgctttaaacaatgacagcctatactgtctgcagggcgtgcgtgctgcacactgtatgctggtatttggaagtcatgctgccattctgtactgtctctcctgtgtttgagagctcaagtagggctctcctgggactcagggggagctaattaccttgaaaaaggcatatagcacccatactatgtttctgtttcttggctgggtttgggtttaggtttttggtttgtttcttgcagtgccatgctgaccttaggccattgttgctggggtctcctcagccagaaaccagcctgcttggagccaaggctcctgtgaggtgcctgaaagtgcccccacagctaggagacctaaagcctcttccttttcttcccattgtgttgactgggtttttcgggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttca

SEQ ID NO: 319627 - DNA, 2491 bp, Homo sapiens
cccggaagaggagcggcgaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtgggagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcgtcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttca

SEQ ID NO: 319628 - DNA, 2228 bp, Homo sapiens
cccggaagaggagcggcgaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtgggagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcgtcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttca

SEQ ID NO: 319629 - DNA, 2502 bp, Homo sapiens
gtatagcttttgtttgggtttttcttctcacctttaaaaaaatgagccatttctatttcattttctctgtaactgtctacttaacccttctgaggcttagtctgtacaatggaggcagtccctccttccctcagaagattacagtaagaattggatgaaataaagcctttagctcagtgcctgacacagaagaacatgcagtgaaggaaagctgctattgctccaacaaagatgtaggccattaaatttttaaaaccattttatacatgcacacatacatacaaggactcctctctcctgcaaaaattgttaccttaagtgtggttctctggttctaaggagggaagtgctaagtaagaaagacagggaggtggatattgtggttccccatcagacagaaaacacgggcacctgtttggtaatctttttcttacagtgttattgctaaattcagacagtcttcctaacccacacctgcttttaaaaagcttagctctaacatgaaactgtatgctttttgcttcttggtgttttgtataaaaaaaatcattataaccctgacagtatgttgcttgaggtctccattttactggtctaatactgctgacattcaggaactgagagccatgccccatcagtggtaagagtatctcctatgtgtgcagtggcaaaagctagggaccatggaaagaaacacaaaatatagacacctctgccttttgtcttacagtggcatatcacaaaagactgcatctgaaacaatgttactgcagctttccagtttctcccaaatgatgatgaaggtgaagataggggtgtgatagctaaaacagtgacttcagggccagggagtcctgtatcaaggaagaaagctgcctgcctgtgttccctgtcatttagtcactggctgtgtcataagacatcttaggagccaggttatctccatcagaaagatacctgttgttgtttttgttagccaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttca

SEQ ID NO: 319630 - DNA, 2107 bp, Homo sapiens
cccggaagaggagcggcgaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtgggagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcgtcagagttcccaggagcccagcactatgtaggaggaaatgcagctttaattggacagaaatttgcagccaactcagatttaaagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttca

SEQ ID NO: 319631 - DNA, 1939 bp, Homo sapiens
cccggaagaggagcggcgaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtggggttcttctttgcggtccagttggtccaaagctacatgagcttcttgatgacaatgtctttgttccaccagagtcattgcaggaagtggatgagttccacctcattttagagtatcaagcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttca

SEQ ID NO: 319632 - DNA, 2910 bp, Homo sapiens
cccggaagaggagcggcgaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtgggagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcgtcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttcaaaaaaaaaaaaaaaaaaaaaaaaaaaaattgtggggggccccgggcccgaaaaaggtttttaaacccttcgttgggggcgggggccacggttaggagacctgggcacggggtccgagaagaatcgcggccctcgtcgagggtggggtttccccacccaaaaaaaaaaggcgcgggcagcgcgtgttggcaccaaccccaagggtggcggggcgtccacggggtccacacagggggccagcgagcaataagacccgccccgggggcgaaaaaacaaagacgaaacacatagaagcgcacagcacaccgacacaacgaaacacctagcaacagcaaacagaacacaaaacgacacaacaaccgcaagacaaaacagagagagcagaga

SEQ ID NO: 319633 - DNA, 1821 bp, Homo sapiens
ggaagagactcttggaggtcctggcctcccagggacatatcttggcagctggctgtggagcttgcctcctgctgcagtgaggcacctcactgtatcccttcagatgtgggcagcagcttgagtaggacagggcagaacatcttcttgcctgagcctctgcatcctgtgctaaaccgaccatggctgcaagctgcagggttgtaacctccatttctgacatccccactggtattccagttcacctagagctggccagtatgactaacagggagctcatgagcagcattgtccatcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttca

SEQ ID NO: 319634 - DNA, 2524 bp, Homo sapiens
cccggaagaggagcggcgaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtgggagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcgtcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttca

SEQ ID NO: 319635 - DNA, 2650 bp, Homo sapiens
cccggaagaggagcggcgaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtggggggctcttccctgctattcactcggcacggctccttcctgacaccttaagaagaaggtgccttgcttccccttcaccttccaccatgaatgtaagtttcctgaggccttcccagccatgctgaactagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcgtcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttca

SEQ ID NO: 319636 - DNA, 2863 bp, Homo sapiens
cccggaagaggagcggcgaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtggggtgagtgccaacggggcctgggtctctgagcctccgaggtcggccttggaggtcgggcggagccgcgcagaaacagggcttctcagaggtccccgggaggcgctgctgtccgcgctggccccttggcgagaagtgtcggacgtctgagtggaacccggttcgtcaccgctgctctttccactcggctggcctctgcgcctttctctcatcccggggctcttccctgctattcactcggcacggctccttcctgacaccttaagaagaaggtgccttgcttccccttcaccttccaccatgaatgtaagtttcctgaggccttcccagccatgctgaactagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcgtcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttca

SEQ ID NO: 319637 - DNA, 2511 bp, Homo sapiens
cccggaagaggagcggcgaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtggggtgagtgccaacggggcctgggtctctgagcctccgaggtcggccttggaggtcgggcggagccgcgcagaaacagggcttctcagaggtccccgggaggcgctgctgtccgcgctggccccttggcgagaagtgtcggacgtctgagtggaacccggttcgtcaccgctgctctttccactcggctggcctctgcgcctttctctcatcccgcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttca

SEQ ID NO: 319638 - DNA, 2601 bp, Homo sapiens
cccggaagaggagcggcgaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtgggagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcgtcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaattgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttcaggaattctgtctgtaattgatttttgtctccatcaccactctggaaccagataagataaaaatcattctgatcttca

SEQ ID NO: 319639 - DNA, 1514 bp, Homo sapiens
ggagggggcgcagtcccgggttcgaccggccgagccccgcgcgccccgcccggcccctgcgcctccgcccggccggccgcggggagggggcatgagccggcgcccgccggcccccgagctgcgggccggcctagagccccgcgcggcgccccgcggagccaagccgtcgccgccgccgccgccaaaccgcgggcgcacgagtgggccgcgcgatgcagcggccgggggagccggcggccgcgcgcttcggcgcccccgagggctgcgcggaccaccggccgcagcgctatcgcagcttcatgattgaggagatcctcacggagccacccgggcccaagggcgccgcgcccgcagccgccgctgccgcggcgggcgagctgctgaagttcggcgtgcaggcgctgctggcggcgcggcccttccacagccacctggccgtgctgaaggccgagcaggcggcggtgttcaagttcccactggcgccgctgggctgttcagggctgagctctgcgttgctggcggcagggcccgggctgcccggcgccgcgggtgcgccacacctgccgctcgagttgcagctccgcgggaagctggaggcggcaggccctggggagccaggcaccaaagccaagaaggggcgtcggagccgcactgtgttcaccgagctgcagctgatgggcctggagaaacgcttcgagaagcagaagtacctttccacgccggacagaatagatcttgctgagtccctgggcctgagccagttgcaggtgaagacgtggtaccagaatcggaggatgaagtggaagaaaatagtgctgcagggcggcggcctggagtctcccaccaagcccaaggggcggcccaagaagaactcaattccaacgagcgagcagcttactgagcaggagcgcgccaaggatgcagagaaaccggcggaggtgccgggcgagcccagcgacaggagccgcgaggactgagggcggtatacggtgcggggcctgggatgcccgcgccacccgcagccccctcactcggcggaaacccgcgagccggcccttccgcgtccaagaagtttacttcctaagcctttttattatgatcttgaatgcggacaattggggccaaacgaggaaggacacagacccaaaagccagacccaggtcccagcgcgcttctgggctctaacctgggagactcgcatccagcccggcggaagctacagtctctaccctgagctccgtggcgcagagcgctccacgcgtattcacgccccgctcctcgcctgcacccccaccccgtctggggcctgccctcccggccggggagcctccaggcacacacccgcttctggacgtcggggacccagcggttgggctcaggccacaacggcctgagattgccccggggcaacccgtcggctcggcctggaggccgggtccccgatgtcgctggggcccctaccccctcttgcgaagacggtgactttttttccaataaaatattttatgacacaa

SEQ ID NO: 319640 - DNA, 310 bp, Homo sapiens
tttttccaataaaatattttatgacacaatcgggctcggtggagcagcttctgaatccgcagggggtgagggtgggggtgggggtgggctcggcaagataagcggaacgcgggcagttgcttcttaaacttcctttcctccggctctgtcgaaggcagctgtgctcttcaccatcaagcccgggctaggcacggcgggcggctcggtggctgcaggatcctaggaatcgcttccactctgggcgtgaggggccagtctgaactccacctcctctcccttgccagccagagagtcgctggcaggagcggtc

SEQ ID NO: 319641 - DNA, 1329 bp, Homo sapiens
  misc_feature (1)..(1): n is a, c, g, or t
  misc_feature (4)..(6): n is a, c, g, or t
  misc_feature (10)..(10): n is a, c, g, or t
nctnnngccnggggaactccaggacagaacacggacagggtcgaggagatactccctcccaaatctggggaacggcaacgttgaggagggtctccatctgcgccaccggcgccgaccggcagggcgtggaggttttgcgctgggaggcactggccaagcgcgagcacccccgcggcacgtggtgcggcagtccctggggcagaggagcgcggccgtagctcacccgggtcctcattctctttcttcgcagccgtgctgaaggccgagcaggcggcggtgttcaagttcccactggcgccgctgggctgttcagggctgagctctgcgttgctggcggcagggcccgggctgcccggcgccgcgggtgcgccacacctgccgctcgagttgcagctccgcgggaagctggaggcggcaggccctggggagccaggcaccaaagccaagaaggggcgtcggagccgcactgtgttcaccgagctgcagctgatgggcctggagaaacgcttcgagaagcagaagtacctttccacgccggacagaatagatcttgctgagtccctgggcctgagccagttgcaggtgaagacgtggtaccagaatcggaggatgaagtggaagaaaatagtgctgcagggcggcggcctggagtctcccaccaagcccaaggggcggcccaagaagaactcaattccaacgagcgagcagcttactgagcaggagcgcgccaaggatgcagagaaaccggcggaggtgccgggcgagcccagcgacaggagccgcgaggactgagggcggtatacggtgcggggcctgggatgcccgcgccacccgcagccccctcactcggcggaaacccgcgagccggcccttccgcgtccaagaagtttacttcctaagcctttttattatgatcttgaatgcggacaattggggccaaacgaggaaggacacagacccaaaagccagacccaggtcccagcgcgcttctgggctctaacctgggagactcgcatccagcccggcggaagctacagtctctaccctgagctccgtggcgcagagcgctccacgcgtattcacgccccgctcctcgcctgcacccccaccccgtctggggcctgccctcccggccggggagcctccaggcacacacccgcttctggacgtcggggacccagcggttgggctcaggccacaacggcctgagattgccccggggcaacccgtcggctcggcctggaggccgggtccccgatgtcgctggggcccctaccccctcttgcgaagacggtgactttttttccaataaaatattttatgacacaa

SEQ ID NO: 319642 - DNA, 3424 bp, Homo sapiens
ggagagaggacctatttctacctaaggacattcccggaaggcaatgggtttcaaacaatatcctgaagagactcatctcggggaactaagcaggtggtaatcagagaacacagagcccccggaagaattttatggcatttcaggcaagccacaggccagcctggggaaaaagcaggaagaaaaactggcaatacgagggcccaacccaaaagttattcctgaagagaaacaacgtgtcagcaccagatgggccttcagaccccagcatctccgcgagcagtgagcaaagcggggcacagcagcctcccggtttacaggttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtgttagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacacaaaaaaaat

SEQ ID NO: 319643 - DNA, 2808 bp, Homo sapiens
aggggagccgcgatccggccgcgccgcccgcacgccgccgcgcccgccccagcccgcccggccccgcggcggggcgcgatgagcccgagcgcgagccggcccgccggggagtgagcgcggggcgcccagggcgcgttgcgtagctgctcctgcgcacaaccccgccgcgccgccggcccgcactggccgcggagtgcaagaggctcgtccgtgcccagcgcccggccggccgcgggagcaggaagcgcaggccacgcaggacccaactgaaacaaagtgtcggccgcccggcgccggcgcccgccccgaccctgcccctcccgcccgcaactccgccgcccaccatggcttccgaggagctgtacgaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtgttagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacacaaaaaaaat

SEQ ID NO: 319644 - DNA, 1855 bp, Homo sapiens
agttaagaatgcacccagtgccaagtgtgaaatgtgctttatacatatgttaggcccgacatattgtgagaaaatgtctggtaacctttttaacaggtgattgctggaatttgatgattgcctccgtaaatgtggaggcacaggggacccgtgtctgcccgcatgcaccctgctaactggctgcttgttttccggtgcaggtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtgttagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacacaaaaaaaat

SEQ ID NO: 319645 - DNA, 1083 bp, Homo sapiens
  misc_feature (11)..(11): n is a, c, g, or t
  misc_feature (15)..(15): n is a, c, g, or t
agctgactctngagnatccctataggcgctaggtgcgagagggccaggatggggagcaggccaggatacacccactagtgcctcaggtgcccggccctgtgactgcagccatggccacaggcttagctgttaacgggaagttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtgagaggcgctcttgggct

SEQ ID NO: 319646 - DNA, 3246 bp, Homo sapiens
  misc_feature (11)..(11): n is a, c, g, or t
  misc_feature (15)..(15): n is a, c, g, or t
agctgactctngagnatccctataggcgctaggtgcgagagggccaggatggggagcaggccaggatacacccactagtgcctcaggtgcccggccctgtgactgcagccatggccacaggcttagctgttaacgggaagttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtgttagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacacaaaaaaaat

SEQ ID NO: 319647 - DNA, 3475 bp, Homo sapiens
aggggagccgcgatccggccgcgccgcccgcacgccgccgcgcccgccccagcccgcccggccccgcggcggggcgcgatgagcccgagcgcgagccggcccgccggggagtgagcgcggggcgcccagggcgcgttgcgtagctgctcctgcgcacaaccccgccgcgccgccggcccgcactggccgcggagtgcaagaggctcgtccgtgcccagcgcccggccggccgcgggagcaggaagcgcaggccacgcaggacccaactgaaacaaagtgtcggccgcccggcgccggcgcccgccccgaccctgcccctcccgcccgcaactccgccgcccaccatggcttccgaggagctgtacgaggttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtgttagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacacaaaaaaaat

SEQ ID NO: 319648 - DNA, 2474 bp, Homo sapiens
cttaacctgcatagcctataaactgttttaagaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtgttagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacacaaaaaaaat

SEQ ID NO: 319649 - DNA, 2290 bp, Homo sapiens
aattccagtgcagctcatggctgcatgttaccctgtggccttcacgtagggcctgtagtgacagccactacatgcgtgggctccaggctgtcaccaaacctttacaacacgtagtaaataagtctagggtccacaactgctggggaaggccttaaacaaatctcaagtcttcaggatttccgtagcatttacatcttggtaaattgaattccataatagacttttcctttgctcaaatatgcaatgttttgagtaattccccatttatttttcattttagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtgttagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacacaaaaaaaat

SEQ ID NO: 319650 - DNA, 906 bp, Homo sapiens
  misc_feature (11)..(11): n is a, c, g, or t
  misc_feature (15)..(15): n is a, c, g, or t
agctgactctngagnatccctataggcgctaggtgcgagagggccaggatggggagcaggccaggatacacccactagtgcctcaggtgcccggccctgtgactgcagccatggccacaggcttagctgttaacgggaagttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaagtgaaaggattgttgacaaaaggaaaaataaaaaagggaagacagagtatttggttcggtggaaaggctatgacagcgaggacgacacttggggcgctcgg

SEQ ID NO: 319651 - DNA, 1002 bp, Homo sapiens
cgtgcgcatgcgcgctcccctctcacgcagccaacatggctccagtggagcacgttgtggcggatgctggggctttcctgcggcatgcggctctgcaggacatcgggaagaacatttacaccatccgggaggtggtcactgagattcgggacaaggccacacgcaggcggctcgctgtcctgccctacgagctgcggttcaaggagcccttaccggaatacgtgcggctggtgactgagttttcaaagaaaacaggagactaccccagcctctctgccacggacatccaagtgcttgcactcacataccagttggaagcagagtttgttggggtgtctcacctaaaacaagaaccacagaaggttaaggtgagctcatcgattcagcacccagaaacacctctgcacatttctggtttccatctgccctacaagcctaaacccccacaagaaacagaaaaaggacactcagcttgtgagcctgagaacctggaatttagttccttcatgttctggagaaaccctttgcccaacatcgatcatgaactgcaggagctgctgattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcgggttggctgcctgaccacagacttcgccatgcagaatgttctgctgcagatgggctggcgtgcggcgggaacggtgcggttcggagggccggtactttgggtgctggtgttcagaacacgtgatgagccggttggtccctgggcagaccgaagtctgcgcggaggcccgttcgtttccggccggggcccggcgcgggtctccggggggccccaggagctggtcggggagctccggtgtcacccgccgctccgtacgtgcgccgcctttgcttcgg

SEQ ID NO: 319652 - DNA, 1084 bp, Homo sapiens
aggttgtgatctatcactgtcattttgagcctcgcgttgtgccatgtgtggccagtgggagcctgtgttcttttgacagatcctggtctgtcaaactttatggcacaacaagaagttcccagagactcagccatctcctgcctgtgccccagaatccgccatttctctcaggagctctggttttttatgcaggatggtttttagaagtaaagatctggggactgggtgtgtctgttgtcctgcagtgtcattgcgtcttggctacaatggacagagctaggaaatacatacatgtgtgtgtaaatacacactggaatgttttgtatttctatttctgtattgtctttagctgaaggtatgtagtcaaaataccgtgttcggtttttcgtgtgtgaattgaggtgggaatcaggtgggaggcggcggcatgtcacacgtagcacatggtaggcagtcaattaccacccgctgtcatctgcctgcaccaggatctgcaaggtcggctgcaccttaccagccatggccttgtgtgactgtggctccccttcttctaatggcccttccttgtcttatttccagtactcgcttcccactcccaaagggggcaaatacgccatcaacccccatctcaccgaggatcagcgcttccctcagctgcgactctcccaaaaggccaggcagaaaaccaacgtgttcgcccctgactacatcgccggggtgtcaccctttgtcgagaatgacatctccagccgctcagctaccctgcaggtccgggacagcaccttgggagctgggcggagacgcttaaatcccaacgcttccagaaagaagtttgtgaagtgcaattgcataaaaacagaaagaacaacgccctggagccaatcttcaagaaaggaatttccaaaggataatatttttctaataaatgcggctgcaacctcctgtgcatttaattaaataggccaaatttttgctgcttaggtcatctcaaggctgatacttgagctgtgtgcccagagatcatgcatttagatttatatttttgccagaaaatacaaggttataataaaactaagaactacca

SEQ ID NO: 319653 - DNA, 1602 bp, Homo sapiens
cgtgcgcatgcgcgctcccctctcacgcagccaacatggctccagtggagcacgttgtggcggatgctggggctttcctgcggcatgcggctctgcaggacatcgggaagaacatttacaccatccgggaggtggtcactgagattcgggacaaggccacacgcaggcggctcgctgtcctgccctacgagctgcggttcaaggagcccttaccggaatacgtgcggctggtgactgagttttcaaagaaaacaggagactaccccagcctctctgccacggacatccaagtgcttgcactcacataccagttggaagcagagtttgttggggtgtctcacctaaaacaagaaccacagaaggttaaggtgagctcatcgattcagcacccagaaacacctctgcacatttctggtttccatctgccctacaagcctaaacccccacaagaaacagaaaaaggacactcagcttgtgagcctgagaacctggaatttagttccttcatgttctggagaaaccctttgcccaacatcgatcatgaactgcaggagctgctgattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcgggttggctgcctgaccacagacttcgccatgcagaatgttctgctgcagatggggctgcacgtgctggcggtgaacggcatgctgattcgtgaggcccggagctacatcttgcgctgccatggctgtttcaagacaacgtctgacatgagccgagtgttctgctcacactgtgggaacaagaccctgaagaaagtgtccgtgaccgtcagcgacgacggcaccctgcacatgcacttctcccgcaaccccaaggtgctgaacccccgcggcctccggtactcgcttcccactcccaaagggggcaaatacgccatcaacccccatctcaccgaggatcagcgcttccctcagctgcgactctcccaaaaggccaggcagaaaaccaacgtgttcgcccctgactacatcgccggggtgtcaccctttgtcgagaatgacatctccagccgctcagctaccctgcaggtccgggacagcaccttgggagctgggcggagacgcttaaatcccaacgcttccagaaagaagtttgtgaagaaaaggtgaagagcgagttcccgcaggcaaattggatgggcgtctggccgccgtggagttccggtgacccatttccccagccgtgtcgtctccaggaccacccgatggaaataacaggcgggcttcacggtgcggctctgtccgcccatgccccgctgggtctgcagggaactggactgtcccatggcctgtgagcaccggagcgcctggctgcctgccaaggaagtgcaattgcataaaaacagaaagaacaacgccctggagccaatcttcaagaaaggaatttccaaaggataatatttttctaataaatgcggctgcaacctcctgtgcattt

SEQ ID NO: 319654 - DNA, 1509 bp, Homo sapiens
cgtgcgcatgcgcgctcccctctcacgcagccaacatggctccagtggagcacgttgtggcggatgctggggctttcctgcggcatgcggctctgcaggacatcgggaagaacatttacaccatccgggaggtggtcactgagattcgggacaaggccacacgcaggcggctcgctgtcctgccctacgagctgcggttcaaggagcccttaccggaatacgtgcggctggtgactgagttttcaaagaaaacaggagactaccccagcctctctgccacggacatccaagtgcttgcactcacataccagttggaagcagagtttgttggggtgtctcacctaaaacaagaaccacagaaggttaaggtgagctcatcgattcagcacccagaaacacctctgcacatttctggtttccatctgccctacaagcctaaacccccacaagaaacagaaaaaggacactcagcttgtgagcctgagaacctggaatttagttccttcatgttctggagaaaccctttgcccaacatcgatcatgaactgcaggagctgctgattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcgggttggctgcctgaccacagacttcgccatgcagaatgttctgctgcagatggggctgcacgtgctggcggtgaacggcatgctgattcgtgaggcccggagctacatcttgcgctgccatggctgtttcaagacaacgtctgacatgagccgagtgttctgctcacactgtgggaacaagaccctgaagaaagtgtccgtgaccgtcagcgacgacggcaccctgcacatgcacttctcccgcaaccccaaggtgctgaacccccgcggcctccggtactcgcttcccactcccaaagggggcaaatacgccatcaacccccatctcaccgaggatcagcgcttccctcagctgcgactctcccaaaaggccaggcagaaaaccaacgtgttcgcccctgactacatcgccggggtgtcaccctttgtcgagaatgacatctccagccgctcagctaccctgcaggtccgggacagcaccttgggagctgggcggagacgcttaaatcccaacgcttccagaaagaagtttgtgaagtgcaattgcataaaaacagaaagaacaacgccctggagccaatcttcaagaaaggaatttccaaaggataatatttttctaataaatgcggctgcaacctcctgtgcatttaattaaataggccaaatttttgctgcttaggtcatctcaaggctgatacttgagctgtgtgcccagagatcatgcatttagatttatatttttgccagaaaatacaaggttataataaaactaagaactacca

SEQ ID NO: 319655 - DNA, 1425 bp, Homo sapiens
gagagagagagagatgagagagagagagagagagagagagagagagagagagagagagagagagagagagagacagcacccagaaacacctctgcacatttctggtttccatctgccctacaagcctaaacccccacaagaaacagaaaaaggacactcagcttgtgagcctgagaacctggaatttagttccttcatgttctggagaaaccctttgcccaacatcgatcatgaactgcaggagctgctgattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcgggttggctgcctgaccacagacttcgccatgcagaatgttctgctgcagatggggctgcacgtgctggcggtgaacggcatgctgattcgtgaggcccggagctacatcttgcgctgccatggctgtttcaagacaacgtctgacatgagccgagtgttctgctcacactgtgggaacaagaccctgaagaaagtgtccgtgaccgtcagcgacgacggcaccctgcacatgcacttctcccgcaaccccaaggtgctgaacccccgcggcctccggtactcgcttcccactcccaaagggggcaaatacgccatcaacccccatctcaccgaggatcagcgcttccctcagctgcgactctcccaaaaggccaggcagaaaaccaacgtgttcgcccctgactacatcgccggggtgtcaccctttgtcgagaatgacatctccagccgctcagctaccctgcaggtccgggacagcaccttgggagctgggcggagacgcttaaatcccaacgcttccagaaagaagtttgtgaagaaaaggtgaagagcgagttcccgcaggcaaattggatgggcgtctggccgccgtggagttccggtgacccatttccccagccgtgtcgtctccaggaccacccgatggaaataacaggcgggcttcacggtgcggctctgtccgcccatgccccgctgggtctgcagggaactggactgtcccatggcctgtgagcaccggagcgcctggctgcctgccaaggaagtgcaattgcataaaaacagaaagaacaacgccctggagccaatcttcaagaaaggaatttccaaaggataatatttttctaataaatgcggctgcaacctcctgtgcatttaattaaataggccaaatttttgctgcttaggtcatctcaaggctgatacttgagctgtgtgcccagagatcatgcatttagatttatatttttgccagaaaatacaaggttataataaaactaagaactacca

SEQ ID NO: 319656 - DNA, 1839 bp, Homo sapiens
  misc_feature (561)..(561): n is a, c, g, or t
  misc_feature (569)..(569): n is a, c, g, or t
  misc_feature (571)..(571): n is a, c, g, or t
  misc_feature (610)..(610): n is a, c, g, or t
cgtgcgcatgcgcgctcccctctcacgcagccaacatggctccagtggagcacgttgtggcggatgctggggctttcctgcggcatgcggctctgcaggacatcgggaagaacatttacaccatccgggaggtggtcactgagattcgggacaaggccacacgcaggcggctcgctgtcctgccctacgagctgcggttcaaggagcccttaccggaatacgtgcggctggtgactgagttttcaaagaaaacaggagactaccccagcctctctgccacggacatccaagtgcttgcactcacataccagttggaagcagagtttgttggggtgtctcacctaaaacaagaaccacagaaggttaaggtgagctcatcgattcagcacccagaaacacctctgcacatttctggtttccatctgccctacaagcctaaacccccacaagaaacagaaaaaggacactcagcttgtgagcctgagaacctggaatttagttccttcatgttctggagaaaccctttgcccaacatcgatcatgaactgcaggagctgctgnatttgaancnaaaaaggggaaaggggttggagggaaaacgggttccaangtgagggaaaagggggggaaaaaggggtggaaaggggggggaaaccggggggggggaaaacaaagggaaaaaaaaaaaaaaaagcgggggtttggacaaaagggggaaaaaccccaagaaaaagatgacagcgatgacgacgggggtggctggataacccccagtaacatcaagcagatccagcaggagctggagcagtgtgacgtccccgaggacgtgcgggttggctgcctgaccacagacttcgccatgcagaatgttctgctgcagatggggctgcacgtgctggcggtgaacggcatgctgattcgtgaggcccggagctacatcttgcgctgccatggctgtttcaagacaacgtctgacatgagccgagtgttctgctcacactgtgggaacaagaccctgaagaaagtgtccgtgaccgtcagcgacgacggcaccctgcacatgcacttctcccgcaaccccaaggtgctgaacccccgcggcctccggtactcgcttcccactcccaaagggggcaaatacgccatcaacccccatctcaccgaggatcagcgcttccctcagctgcgactctcccaaaaggccaggcagaaaaccaacgtgttcgcccctgactacatcgccggggtgtcaccctttgtcgagaatgacatctccagccgctcagctaccctgcaggtccgggacagcaccttgggagctgggcggagacgcttaaatcccaacgcttccagaaagaagtttgtgaagaaaaggtgaagagcgagttcccgcaggcaaattggatgggcgtctggccgccgtggagttccggtgacccatttccccagccgtgtcgtctccaggaccacccgatggaaataacaggcgggcttcacggtgcggctctgtccgcccatgccccgctgggtctgcagggaactggactgtcccatggcctgtgagcaccggagcgcctggctgcctgccaaggaagtgcaattgcataaaaacagaaagaacaacgccctggagccaatcttcaagaaaggaatttccaaaggataatatttttctaataaatgcggctgcaacctcctgtgcatttaattaaataggccaaatttttgctgcttaggtcatctcaaggctgatacttgagctgtgtgcccagagatcatgcatttagatttatatttttgccagaaaatacaaggttataataaaactaagaactacca

SEQ ID NO: 319657 - DNA, 1310 bp, Homo sapiens
aggttgtgatctatcactgtcattttgagcctcgcgttgtgccatgtgtggccagtgggagcctgtgttcttttgacagatcctggtctgtcaaactttatggcacaacaagaagttcccagagactcagccatctcctgcctgtgccccagaatccgccatttctctcaggagctctggttttttatgcaggatggtttttagaagtaaagatctggggactgggtgtgtctgttgtcctgcagtgtcattgcgtcttggctacaatggacagagctaggaaatacatacatgtgtgtgtaaatacacactggaatgttttgtatttctatttctgtattgtctttagctgaaggtatgtagtcaaaataccgtgttcggtttttcgtgtgtgaattgaggtgggaatcaggtgggaggcggcggcatgtcacacgtagcacatggtaggcagtcaattaccacccgctgtcatctgcctgcaccaggatctgcaaggtcggctgcaccttaccagccatggccttgtgtgactgtggctccccttcttctaatggcccttccttgtcttatttccagtactcgcttcccactcccaaagggggcaaatacgccatcaacccccatctcaccgaggatcagcgcttccctcagctgcgactctcccaaaaggccaggcagaaaaccaacgtgttcgcccctgactacatcgccggggtgtcaccctttgtcgagaatgacatctccagccgctcagctaccctgcaggtccgggacagcaccttgggagctgggcggagacgcttaaatcccaacgcttccagaaagaagtttgtgaagaaaaggtgaagagcgagttcccgcaggcaaattggatgggcgtctggccgccgtggagttccggtgacccatttccccagccgtgtcgtctccaggaccacccgatggaaataacaggcgggcttcacggtgcggctctgtccgcccatgccccgctgggtctgcagggaactggactgtcccatggcctgtgagcaccggagcgcctggctgcctgccaaggaagtgcaattgcataaaaacagaaagaacaacgccctggagccaatcttcaagaaaggaatttccaaaggataatatttttctaataaatgcggctgcaacctcctgtgcatttaattaaataggccaaatttttgctgcttaggtcatctcaaggctgatacttgagctgtgtgcccagagatcatgcatttagatttatatttttgccagaaaatacaaggttataataaaactaagaactacca

SEQ ID NO: 319658 - DNA, 591 bp, Homo sapiens
ttcagtatatataatgccatgtggtcagtcaggttcttaacacagggagagagggttttcagcccagcaatgagtatatttggcccagacaaaataaaatgtctgttgagagagcttgctaatgacaggtcatggaaaatgacgaacacaggctccaggacggtgttagaaagacacctgggccttcgtcctcgtttacacatcttgagaggcctccccaggctgagtttccttcgcaaaagccaaggaatatgggcaaggcagggtttgtgaagttcccttaactgtaattacaaaatgaaatgtgaaaagaaaattgatttcttctttaacttgtggttgtagaatgttctgctgcagatggggctgcacgtgctggcggtgaacggcatgctgattcgtgaggcccggagctacatcttgcgctgccatggctgtttcaagtatgtagctggtgccctggccctggtgccctctgtggaacactcttcctgtttctttttttgttttgagaaacagtctcgctctgtcacctaggctggagtgcagtggtacaatctcagctcactgcaacctctgcctcctgggttc

SEQ ID NO: 319659 - DNA, 1735 bp, Homo sapiens
cgtgcgcatgcgcgctcccctctcacgcagccaacatggctccagtggagcacgttgtggcggatgctggggctttcctgcggcatgcggctctgcaggacatcgggaagaacatttacaccatccgggaggtggtcactgagattcgggacaaggccacacgcaggcggctcgctgtcctgccctacgagctgcggttcaaggagcccttaccggaatacgtgcggctggtgactgagttttcaaagaaaacaggagactaccccagcctctctgccacggacatccaagtgcttgcactcacataccagttggaagcagagtttgttggggtgtctcacctaaaacaagaaccacagaaggttaaggtgagctcatcgattcagcacccagaaacacctctgcacatttctggtttccatctgccctacaagcctaaacccccacaagaaacagaaaaaggacactcagcttgtgagcctgagaacctggaatttagttccttcatgttctggagaaaccctttgcccaacatcgatcatgaactgcaggagctgctgattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcgggttggctgcctgaccacagacttcgccatgcagaatgttctgctgcagatggggctgcacgtgctggcggtgaacggcatgctgattcgtgaggcccggagctacatcttgcgctgccatggctgtttcaagacaacgtctgacatgagccgagtgttctgctcacactgtgggaacaagaccctgaagaaagtgtccgtgaccgtcagcgacgacggcaccctgcacatgcacttctcccgcaaccccaaggtgctgaacccccgcggcctccggtactcgcttcccactcccaaagggggcaaatacgccatcaacccccatctcaccgaggatcagcgcttccctcagctgcgactctcccaaaaggccaggcagaaaaccaacgtgttcgcccctgactacatcgccggggtgtcaccctttgtcgagaatgacatctccagccgctcagctaccctgcaggtccgggacagcaccttgggagctgggcggagacgcttaaatcccaacgcttccagaaagaagtttgtgaagaaaaggtgaagagcgagttcccgcaggcaaattggatgggcgtctggccgccgtggagttccggtgacccatttccccagccgtgtcgtctccaggaccacccgatggaaataacaggcgggcttcacggtgcggctctgtccgcccatgccccgctgggtctgcagggaactggactgtcccatggcctgtgagcaccggagcgcctggctgcctgccaaggaagtgcaattgcataaaaacagaaagaacaacgccctggagccaatcttcaagaaaggaatttccaaaggataatatttttctaataaatgcggctgcaacctcctgtgcatttaattaaataggccaaatttttgctgcttaggtcatctcaaggctgatacttgagctgtgtgcccagagatcatgcatttagatttatatttttgccagaaaatacaaggttataataaaactaagaactacca

SEQ ID NO: 319660 - DNA, 1426 bp, Homo sapiens
  misc_feature (1266)..(1266): n is a, c, g, or t
  misc_feature (1270)..(1271): n is a, c, g, or t
  misc_feature (1280)..(1280): n is a, c, g, or t
  misc_feature (1282)..(1282): n is a, c, g, or t
  misc_feature (1293)..(1293): n is a, c, g, or t
  misc_feature (1297)..(1297): n is a, c, g, or t
cgtgcgcatgcgcgctcccctctcacgcagccaacatggctccagtggagcacgttgtggcggatgctggggctttcctgcggcatgcggctctgcaggacatcgggaagaacatttacaccatccgggaggtggtcactgagattcgggacaaggccacacgcaggcggctcgctgtcctgccctacgagctgcggttcaaggagcccttaccggaatacgtgcggctggtgactgagttttcaaagaaaacaggagactaccccagcctctctgccacggacatccaagtgcttgcactcacataccagttggaagcagagtttgttggggtgtctcacctaaaacaagaaccacagaaggttaaggtgagctcatcgattcagcacccagaaacacctctgcacatttctggtttccatctgccctacaagcctaaacccccacaagaaacagaaaaaggacactcagcttgtgagcctgagaacctggaatttagttccttcatgttctggagaaaccctttgcccaacatcgatcatgaactgcaggagctgctgattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcgggttggctgcctgaccacagacttcgccatgcagaatgttctgctgcagatggggctgcacgtgctggcggtgaacggcatgctgattcgtgaggcccggagctacatcttgcgctgccatggctgtttcaagacaacgtctgacatgagccgagtgttctgctcacactgtgggaacaagaccctgaagaaagtgtccgtgaccgtcagcgacgacggcaccctgcacatgcacttctcccgcaaccccaaggtgctgaacccccgcggcctccggtactcgcttcccactcccaaagggggcaaatacgccatcaacccccatctcaccgaggatcagcgcttccctcagctgcgactctcccaaaaggccaggcagaaaaccaacgtgttcgcccctgactacatcgccggggtgtcaccctttgtcgagaatgacatctccagccgctcagctaccctgcaggtccgggacagcaccttgggagctgggcggagacgcttaaatcccaacgcttccagaaagaagtttgtgaagngagnncgagtccgngnaatggtggcgnggcncggatccgggaccttcccgcggggttcggcccgggaaaaagggccggggcgcccacccggtgaagggccgtgacacgtgcggagggaaaaaccggcaaagataaggggaaggcgggagcaacagggtca

SEQ ID NO: 319661 - DNA, 1856 bp, Homo sapiens
cgtgcgcatgcgcgctcccctctcacgcagccaacatggctccagtggagcacgttgtggcggatgctggggctttcctgcggcatgcggctctgcaggtacggggagctccctccgggacgagagagatctgggctggccgcccctcccggagtgcgtggagtcgcgcggagcgttgcttggtgcgggtgggtctgagctggggcgttctgtccgcaggacatcgggaagaacatttacaccatccgggaggtggtcactgagattcgggacaaggccacacgcaggcggctcgctgtcctgccctacgagctgcggttcaaggagcccttaccggaatacgtgcggctggtgactgagttttcaaagaaaacaggagactaccccagcctctctgccacggacatccaagtgcttgcactcacataccagttggaagcagagtttgttggggtgtctcacctaaaacaagaaccacagaaggttaaggtgagctcatcgattcagcacccagaaacacctctgcacatttctggtttccatctgccctacaagcctaaacccccacaagaaacagaaaaaggacactcagcttgtgagcctgagaacctggaatttagttccttcatgttctggagaaaccctttgcccaacatcgatcatgaactgcaggagctgctgattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcgggttggctgcctgaccacagacttcgccatgcagaatgttctgctgcagatggggctgcacgtgctggcggtgaacggcatgctgattcgtgaggcccggagctacatcttgcgctgccatggctgtttcaagacaacgtctgacatgagccgagtgttctgctcacactgtgggaacaagaccctgaagaaagtgtccgtgaccgtcagcgacgacggcaccctgcacatgcacttctcccgcaaccccaaggtgctgaacccccgcggcctccggtactcgcttcccactcccaaagggggcaaatacgccatcaacccccatctcaccgaggatcagcgcttccctcagctgcgactctcccaaaaggccaggcagaaaaccaacgtgttcgcccctgactacatcgccggggtgtcaccctttgtcgagaatgacatctccagccgctcagctaccctgcaggtccgggacagcaccttgggagctgggcggagacgcttaaatcccaacgcttccagaaagaagtttgtgaagaaaaggtgaagagcgagttcccgcaggcaaattggatgggcgtctggccgccgtggagttccggtgacccatttccccagccgtgtcgtctccaggaccacccgatggaaataacaggcgggcttcacggtgcggctctgtccgcccatgccccgctgggtctgcagggaactggactgtcccatggcctgtgagcaccggagcgcctggctgcctgccaaggaagtgcaattgcataaaaacagaaagaacaacgccctggagccaatcttcaagaaaggaatttccaaaggataatatttttctaataaatgcggctgcaacctcctgtgcatttaattaaataggccaaatttttgctgcttaggtcatctcaaggctgatacttgagctgtgtgcccagagatcatgcatttagatttatatttttgccagaaaatacaaggttataataaaactaagaactacca

SEQ ID NO: 319662 - DNA, 1337 bp, Homo sapiens
cgtgcgcatgcgcgctcccctctcacgcagccaacatggctccagtggagcacgttgtggcggatgctggggctttcctgcggcatgcggctctgcaggacatcgggaagaacatttacaccatccgggaggtggtcactgagattcgggacaaggccacacgcaggcggctcgctgtcctgccctacgagctgcggttcaaggagcccttaccggaatacgtgcggctggtgactgagttttcaaagaaaacaggagactaccccagcctctctgccacggacatccaagtgcttgcactcacataccagttggaagcagagtttgttggggtgtctcacctaaaacaagaaccacagaaggttaaggtgagctcatcgattcagcacccagaaacacctctgcacatttctggtttccatctgccctacaagcctaaacccccacaagaaacagaaaaaggacactcagcttgtgagcctgagaacctggaatttagttccttcatgttctggagaaaccctttgcccaacatcgatcatgaactgcaggagctgctgattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcgggttggctgcctgaccacagacttcgccatgcagaatgttctgctgcagatggggctgcacgtgctggcggtgaacggcatgctgattcgtgaggcccggagctacatcttgcgctgccatggctgtttcaagacaacgtctgacatgagccgagtgttctgctcacactgtgggaacaagaccctgaagaaagtgtccgtgaccgtcagcgacgacggcaccctgcacatgcacttctcccgcaaccccaaggtgctgaacccccgcggcctccggtactcgcttcccactcccaaagggggcaaatacgccatcaacccccatggcctgtgagcaccggagcgcctggctgcctgccaaggaagtgcaattgcataaaaacagaaagaacaacgccctggagccaatcttcaagaaaggaatttccaaaggataatatttttctaataaatgcggctgcaacctcctgtgcatttaattaaataggccaaatttttgctgcttaggtcatctcaaggctgatacttgagctgtgtgcccagagatcatgcatttagatttatatttttgccagaaaatacaaggttataataaaactaagaactacca

SEQ ID NO: 319663 - DNA, 1604 bp, Homo sapiens
cgtgcgcatgcgcgctcccctctcacgcagccaacatggctccagtggagcacgttgtggcggatgctggggctttcctgcggcatgcggctctgcaggacatcgggaagaacatttacaccatccgggaggtggtcactgagattcgggacaaggccacacgcaggcggctcgctgtcctgccctacgagctgcggttcaaggagcccttaccggaatacgtgcggctgggttaaggtgagctcatcgattcagcacccagaaacacctctgcacatttctggtttccatctgccctacaagcctaaacccccacaagaaacagaaaaaggacactcagcttgtgagcctgagaacctggaatttagttccttcatgttctggagaaaccctttgcccaacatcgatcatgaactgcaggagctgctgattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcgggttggctgcctgaccacagacttcgccatgcagaatgttctgctgcagatggggctgcacgtgctggcggtgaacggcatgctgattcgtgaggcccggagctacatcttgcgctgccatggctgtttcaagacaacgtctgacatgagccgagtgttctgctcacactgtgggaacaagaccctgaagaaagtgtccgtgaccgtcagcgacgacggcaccctgcacatgcacttctcccgcaaccccaaggtgctgaacccccgcggcctccggtactcgcttcccactcccaaagggggcaaatacgccatcaacccccatctcaccgaggatcagcgcttccctcagctgcgactctcccaaaaggccaggcagaaaaccaacgtgttcgcccctgactacatcgccggggtgtcaccctttgtcgagaatgacatctccagccgctcagctaccctgcaggtccgggacagcaccttgggagctgggcggagacgcttaaatcccaacgcttccagaaagaagtttgtgaagaaaaggtgaagagcgagttcccgcaggcaaattggatgggcgtctggccgccgtggagttccggtgacccatttccccagccgtgtcgtctccaggaccacccgatggaaataacaggcgggcttcacggtgcggctctgtccgcccatgccccgctgggtctgcagggaactggactgtcccatggcctgtgagcaccggagcgcctggctgcctgccaaggaagtgcaattgcataaaaacagaaagaacaacgccctggagccaatcttcaagaaaggaatttccaaaggataatatttttctaataaatgcggctgcaacctcctgtgcatttaattaaataggccaaatttttgctgcttaggtcatctcaaggctgatacttgagctgtgtgcccagagatcatgcatttagatttatatttttgccagaaaatacaaggttataataaaactaagaactacca

SEQ ID NO: 319664 - DNA, 1784 bp, Homo sapiens
cgtgcgcatgcgcgctcccctctcacgcagccaacatggctccagtggagcacgttgtggcggatgctggggctttcctgcggcatgcggctctgcaggtacggggagctccctccgggacgagagagatctgggctggccgcccctcccggagtgcgtggagtcgcgcggagcgttgcttggtgcgggtgggtctgagctggggcgttctgtccgcaggacatcgggaagaacatttacaccatccgggaggtggtcactgagattcgggacaaggccacacgcaggcggctcgctgtcctgccctacgagctgcggttcaaggagcccttaccggaatacgtgcggctggtgactgagttttcaaagaaaacaggagactaccccagcctctctgccacggacatccaagtgcttgcactcacataccagttggaagcagagtttgttggggtgtctcacctaaaacaagaaccacagaagcctaaacccccacaagaaacagaaaaaggacactcagcttgtgagcctgagaacctggaatttagttccttcatgttctggagaaaccctttgcccaacatcgatcatgaactgcaggagctgctgattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcgggttggctgcctgaccacagacttcgccatgcagaatgttctgctgcagatggggctgcacgtgctggcggtgaacggcatgctgattcgtgaggcccggagctacatcttgcgctgccatggctgtttcaagacaacgtctgacatgagccgagtgttctgctcacactgtgggaacaagaccctgaagaaagtgtccgtgaccgtcagcgacgacggcaccctgcacatgcacttctcccgcaaccccaaggtgctgaacccccgcggcctccggtactcgcttcccactcccaaagggggcaaatacgccatcaacccccatctcaccgaggatcagcgcttccctcagctgcgactctcccaaaaggccaggcagaaaaccaacgtgttcgcccctgactacatcgccggggtgtcaccctttgtcgagaatgacatctccagccgctcagctaccctgcaggtccgggacagcaccttgggagctgggcggagacgcttaaatcccaacgcttccagaaagaagtttgtgaagaaaaggtgaagagcgagttcccgcaggcaaattggatgggcgtctggccgccgtggagttccggtgacccatttccccagccgtgtcgtctccaggaccacccgatggaaataacaggcgggcttcacggtgcggctctgtccgcccatgccccgctgggtctgcagggaactggactgtcccatggcctgtgagcaccggagcgcctggctgcctgccaaggaagtgcaattgcataaaaacagaaagaacaacgccctggagccaatcttcaagaaaggaatttccaaaggataatatttttctaataaatgcggctgcaacctcctgtgcatttaattaaataggccaaatttttgctgcttaggtcatctcaaggctgatacttgagctgtgtgcccagagatcatgcatttagatttatatttttgccagaaaatacaaggttataataaaactaagaactacca

SEQ ID NO: 319665 - DNA, 4730 bp, Homo sapiens
ggagggggcgtcgggaaagccccgacttcgcagccttacactcttcgtgggcggcgaccgcggccccactgacatcattcctcatgagggaggaggcacaaacagttctgggccgaccagaaaaaggacgactgggacttgactctgaatcgcaggatttgaagagatttctcctggcttcccaacgaggctggtgggaagcggtcctcctcccatacacgacctcccaccctcgcgaggcgtagaaaccagttctgactgtacagtaaagcgagggccagggctgaggtctggaagctaatgaaagcacagaaagtgtcgaaactggatgagcaggaagcgagtggcctcccctgtcatctgacgttttcccaggatgtaatttgcctgactgaaacagatcaggaccaacagggagagttttcgatttagtgtgaggaaaagagcactaaattgtagcaaaagaccttattgctcaaggcccagtcagaagatttcataaggaagctgtagaaagtcttaagaggaaatcagccgggcgtggtggcgggcacctgtaatcccagctactccggaggctgaggcaggagaatcgcttgaacccggggagcagaggttgcagtgagccgagatcgcgccactgtacgccagcctgggcgaaagaacgaaactccgtctccaaaaaaaaaaaaaacgaagaaaaagtccaaagagggtaaaggctgttctccccttaaaaaacagctaaagacctttgggggcgctgctccttgtaaatgtcaactacttccgcgggaaagaacgcgcaggcacttggccttgtgggcgctcacttgccccggaagtactgttgagttagcgcctcgccttccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatataagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataa

SEQ ID NO: 319666 - DNA, 4901 bp, Homo sapiens
ggagggggcgtcgggaaagccccgacttcgcagccttacactcttcgtgggcggcgaccgcggccccactgacatcattcctcatgagggaggaggcacaaacagttctgggccgaccagaaaaaggacgactgggacttgactctgaatcgcaggatttgaagagatttctcctggcttcccaacgaggctggtgggaagcggtcctcctcccatacacgacctcccaccctcgcgaggcgtagaaaccagttctgactgtacagtaaagcgagggccagggctgaggtctggaagctaatgaaagcacagaaagtgtcgaaactggatgagcaggaagcgagtggcctcccctgtcatctgacgttttcccaggatgtaatttgcctgactgaaacagatcaggaccaacagggagagttttcgatttagtgtgaggaaaagagcactaaattgtagcaaaagaccttattgctcaaggcccagtcagaagatttcataaggaagctgtagaaagtcttaagaggaaatcagccgggcgtggtggcgggcacctgtaatcccagctactccggaggctgaggcaggagaatcgcttgaacccggggagcagaggttgcagtgagccgagatcgcgccactgtacgccagcctgggcgaaagaacgaaactccgtctccaaaaaaaaaaaaaacgaagaaaaagtccaaagagggtaaaggctgttctccccttaaaaaacagctaaagacctttgggggcgctgctccttgtaaatgtcaactacttccgcgggaaagaacgcgcaggcacttggccttgtgggcgctcacttgccccggaagtactgttgagttagcgcctcgccttccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagtgtatgttcagtgacttcctgacgaagcttaacattgtttcaattggcaaaggaaaaatattcgaagggtacagatccatgttcatggagccagcaaaaaggatgaagaagagcttggacacaaccgataactggcacatccgtccagaacccttctccctctcaatccctccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatataagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataa

SEQ ID NO: 319667 - DNA, 511 bp, Homo sapiens
agcggcgccctttttttataccatgggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatataagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaa

SEQ ID NO: 319668 - DNA, 1926 bp, Homo sapiens
ggagggggcgtcgggaaagccccgacttcgcagccttacactcttcgtgggcggcgaccgcggccccactgacatcattcctcatgagggaggaggcacaaacagttctgggccgaccagaaaaaggacgactgggacttgactctgaatcgcaggatttgaagagatttctcctggcttcccaacgaggctggtgggaagcggtcctcctcccatacacgacctcccaccctcgcgaggcgtagaaaccagttctgactgtacagtaaagcgagggccagggctgaggtctggaagctaatgaaagcacagaaagtgtcgaaactggatgagcaggaagcgagtggcctcccctgtcatctgacgttttcccaggatgtaatttgcctgactgaaacagatcaggaccaacagggagagttttcgatttagtgtgaggaaaagagcactaaattgtagcaaaagaccttattgctcaaggcccagtcagaagatttcataaggaagctgtagaaagtcttaagaggaaatcagccgggcgtggtggcgggcacctgtaatcccagctactccggaggctgaggcaggagaatcgcttgaacccggggagcagaggttgcagtgagccgagatcgcgccactgtacgccagcctgggcgaaagaacgaaactccgtctccaaaaaaaaaaaaaacgaagaaaaagtccaaagagggtaaaggctgttctccccttaaaaaacagctaaagacctttgggggcgctgctccttgtaaatgtcaactacttccgcgggaaagaacgcgcaggcacttggccttgtgggcgctcacttgccccggaagtactgttgagttagcgcctcgccttccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaagattctttagttggaccccaggcacggcaagaaccttctggccgagctgggcgggagaactgatgtcctttatatgcgtcggaagcgaagtggtgacaggttggggggttgggaacagccggatcagaaaacattaagcgagccagggcgatgcgcacggggtcaataacggggacacacaaacgggaggggaacagaagagacccacagggtcacttaacgggcaacgaaataccgtcagaacacacgaggttacccagcagagcacccaaagaccaaaccgaggaaaagcca

SEQ ID NO: 319669 - DNA, 1349 bp, Homo sapiens
ggagggggcgtcgggaaagccccgacttcgcagccttacactcttcgtgggcggcgaccgcggccccactgacatcattcctcatgagggaggaggcacaaacagttctgggccgaccagaaaaaggacgactgggacttgactctgaatcgcaggatttgaagagatttctcctggcttcccaacgaggctggtgggaagcggtcctcctcccatacacgacctcccaccctcgcgaggcgtagaaaccagttctgactgtacagtaaagcgagggccagggctgaggtctggaagctaatgaaagcacagaaagtgtcgaaactggatgagcaggaagcgagtggcctcccctgtcatctgacgttttcccaggatgtaatttgcctgactgaaacagatcaggaccaacagggagagttttcgatttagtgtgaggaaaagagcactaaattgtagcaaaagaccttattgctcaaggcccagtcagaagatttcataaggaagctgtagaaagtcttaagaggaaatcagccgggcgtggtggcgggcacctgtaatcccagctactccggaggctgaggcaggagaatcgcttgaacccggggagcagaggttgcagtgagccgagatcgcgccactgtacgccagcctgggcgaaagaacgaaactccgtctccaaaaaaaaaaaaaacgaagaaaaagtccaaagagggtaaaggctgttctccccttaaaaaacagctaaagacctttgggggcgctgctccttgtaaatgtcaactacttccgcgggaaagaacgcgcaggcacttggccttgtgggcgctcacttgccccggaagtactgttgagttagcgcctcgccttccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgaggtaacttagatatatttagtacattacgttcctcttgcttgtatcgacatcattcaagagctcttcaaagcatttgttcagatcttcagtactggccaggtatgaagcaacaaccataaattgtg

SEQ ID NO: 319670 - DNA, 1546 bp, Homo sapiens
atatagccttaaaaatattaataagggcatttaataacttgattcattaccttgatcccattaactattttccttgatagatcttatgttcctcaagtggggattctcttgccacagaatttggagagagaatatagtttatttgagtattaaattatgtttaatctcttctttattcctacagcttaaaattggaattatatctattattttgaccaaatatattttagtcttcttttagtacatggatattatctttcaagttctcttttaataaaccagccaagtctttttttaaccataaatttcattgaagtttaacaaattcacacaacagtgcacaaatccataaattttcacaaactgtctgtgttataagtacccagctcaagaaatagaaccttagcagaagcccagaacctccttgatgcctccttctggttactaacctagggacaatttcctgtctaataccatacatgaattttccctatttttgaattttagataaatgtaatccatatagaatatcctcttttgtatgaggcttcttttattcaacatgtttgtgagatccatctatgttacttggagttgaggtttatttatcctttattgcatagtatcccattataagaatactacaacacggtgcaattacactactttagggtggacatttatttctagtttttggttcaaatacagctggtgtgactatttttatacaagtctcttggtgaacatatgtacacgcttctcctggacctaggaatggacaaagctttgttttgtatttttttaaatactctgaaaagaaaatgctatgtttttaaccattaacttgattaaaacattattacatttttaattatttaatcagaataactttcaaagatcatttcaagtctaacaaaaaaacataactttgttctttaataagtgtaatatttcctggaaatatgcctgggaatttttcttgaaataataagcgaatcttgacattaattggacattttcagaatgccctttggcgtgaagctatgtttcatgttttagaatgctcctctctaggtactttctttttaaccctgtccaatgtacttgacttttgttttctcactgagaaaatgaaagttcagaatgatttttttggggatagtaaggagactttgcataatgggaaataatggtcaggggaaaaccctttgttttataaggggccatttttgtatgctttttttactgaaacagagaaggtcaggttaattccatatccaaattaaatttatgattttcaaaagggaagccttgataatctaaccaaacgtgtccattatctaaagttatttggaaaattgtgtcactttaggtggaggaagctaaacaagaattacaggaagttgttgaattcttgaaaaatccacaaaaatttactattcttggaggtaaacttccaaaaggtaagatatcttttctttatcatgatttgatggaaaaaacaaaaacaaagaaacaaacaaaaaaaacctatattacttattta

SEQ ID NO: 319671 - DNA, 439 bp, Homo sapiens
aatataattttttaacctatgtcaaacctcatatgactgatctcagtaaaacgaactgtgaaaatatttgcatcaatttatttttaaatattaaaaaaaggaaatatatttgttagacttttaaaatctgattgttttaactgataatatgtactccttaggttaaatatcttgataatattaatgcatacctggttgacccaatcttttacagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtatgttaatgtgttttttgttccaattaaatattttagcactattaataattatagatacc

SEQ ID NO: 319672 - DNA, 5078 bp, Homo sapiens
ggagggggcgtcgggaaagccccgacttcgcagccttacactcttcgtgggcggcgaccgcggccccactgacatcattcctcatgagggaggaggcacaaacagttctgggccgaccagaaaaaggacgactgggacttgactctgaatcgcaggatttgaagagatttctcctggcttcccaacgaggctggtgggaagcggtcctcctcccatacacgacctcccaccctcgcgaggcgtagaaaccagttctgactgtacagtaaagcgagggccagggctgaggtctggaagctaatgaaagcacagaaagtgtcgaaactggatgagcaggaagcgagtggcctcccctgtcatctgacgttttcccaggatgtaatttgcctgactgaaacagatcaggaccaacagggagagttttcgatttagtgtgaggaaaagagcactaaattgtagcaaaagaccttattgctcaaggcccagtcagaagatttcataaggaagctgtagaaagtcttaagaggaaatcagccgggcgtggtggcgggcacctgtaatcccagctactccggaggctgaggcaggagaatcgcttgaacccggggagcagaggttgcagtgagccgagatcgcgccactgtacgccagcctgggcgaaagaacgaaactccgtctccaaaaaaaaaaaaaacgaagaaaaagtccaaagagggtaaaggctgttctccccttaaaaaacagctaaagacctttgggggcgctgctccttgtaaatgtcaactacttccgcgggaaagaacgcgcaggcacttggccttgtgggcgctcacttgccccggaagtactgttgagttagcgcctcgccttccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatataagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataatttaagctgtatatggtcttcattgaaaaaagatagatattgttacaggaagcttgttacattatattcttgaccttttggttgataatcttaaatcttaatgtaatttcaaactggcagaaatgttgccagcataatacatggatgtctcatataccctgcatccagatttaccagttgttatcattctgcccgttttttattgccccaaacctgttctgtctccctctctgtatgtacatacatacacgtataaaatattgatgaagtcttatctgtcttaaatttttttacatatttgttgaggtataatttacatatgataaaattcattttaaatgtagagtt

SEQ ID NO: 319673 - DNA, 4750 bp, Homo sapiens
ggagggggcgtcgggaaagccccgacttcgcagccttacactcttcgtgggcggcgaccgcggccccactgacatcattcctcatgagggaggaggcacaaacagttctgggccgaccagaaaaaggacgactgggacttgactctgaatcgcaggatttgaagagatttctcctggcttcccaacgaggctggtgggaagcggtcctcctcccatacacgacctcccaccctcgcgaggcgtagaaaccagttctgactgtacagtaaagcgagggccagggctgaggtctggaagctaatgaaagcacagaaagtgtcgaaactggatgagcaggaagcgagtggcctcccctgtcatctgacgttttcccaggatgtaatttgcctgactgaaacagatcaggaccaacagggagagttttcgatttagtgtgaggaaaagagcactaaattgtagcaaaagaccttattgctcaaggcccagtcagaagatttcataaggaagctgtagaaagtcttaagaggaaatcagccgggcgtggtggcgggcacctgtaatcccagctactccggaggctgaggcaggagaatcgcttgaacccggggagcagaggttgcagtgagccgagatcgcgccactgtacgccagcctgggcgaaagaacgaaactccgtctccaaaaaaaaaaaaaacgaagaaaaagtccaaagagggtaaaggctgttctccccttaaaaaacagctaaagacctttgggggcgctgctccttgtaaatgtcaactacttccgcgggaaagaacgcgcaggcacttggccttgtgggcgctcacttgccccggaagtactgttgagttagcgcctcgccttccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatataagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataaccaaaaaaaaaaaaaaaaaaaaaaaaaaaatttttgggccgccgggccccgaaaaagtttttaaaccaatttcggtgttggggccgccgcggcccccatgtgtttatgtgaacagtggtgccaaaggggtgttcccaaggagaaaacccggtgctcctaggacactcgtgggcgtgggttttcttcccccatattaaaagaggcgccgtgtgggaaaccccgatggtttctgagaacaacccggaaggggatccggaggctatagaggggttctacaaagagggagctccagagagagtggatttaaattgcccg

SEQ ID NO: 319674 - DNA, 3645 bp, Homo sapiens
ggagggggcgtcgggaaagccccgacttcgcagccttacactcttcgtgggcggcgaccgcggccccactgacatcattcctcatgagggaggaggcacaaacagttctgggccgaccagaaaaaggacgactgggacttgactctgaatcgcaggatttgaagagatttctcctggcttcccaacgaggctggtgggaagcggtcctcctcccatacacgacctcccaccctcgcgaggcgtagaaaccagttctgactgtacagtaaagcgagggccagggctgaggtctggaagctaatgaaagcacagaaagtgtcgaaactggatgagcaggaagcgagtggcctcccctgtcatctgacgttttcccaggatgtaatttgcctgactgaaacagatcaggaccaacagggagagttttcgatttagtgtgaggaaaagagcactaaattgtagcaaaagaccttattgctcaaggcccagtcagaagatttcataaggaagctgtagaaagtcttaagaggaaatcagccgggcgtggtggcgggcacctgtaatcccagctactccggaggctgaggcaggagaatcgcttgaacccggggagcagaggttgcagtgagccgagatcgcgccactgtacgccagcctgggcgaaagaacgaaactccgtctccaaaaaaaaaaaaaacgaagaaaaagtccaaagagggtaaaggctgttctccccttaaaaaacagctaaagacctttgggggcgctgctccttgtaaatgtcaactacttccgcgggaaagaacgcgcaggcacttggccttgtgggcgctcacttgccccggaagtactgttgagttagcgcctcgccttccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatataagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcggtgtttgagattgcggtgtttgggattgcggtgtttgagattgcggtggttggggtaccgagc

SEQ ID NO: 319675 - DNA, 4188 bp, Homo sapiens
atatagccttaaaaatattaataagggcatttaataacttgattcattaccttgatcccattaactattttccttgatagatcttatgttcctcaagtggggattctcttgccacagaatttggagagagaatatagtttatttgagtattaaattatgtttaatctcttctttattcctacagcttaaaattggaattatatctattattttgaccaaatatattttagtcttcttttagtacatggatattatctttcaagttctcttttaataaaccagccaagtctttttttaaccataaatttcattgaagtttaacaaattcacacaacagtgcacaaatccataaattttcacaaactgtctgtgttataagtacccagctcaagaaatagaaccttagcagaagcccagaacctccttgatgcctccttctggttactaacctagggacaatttcctgtctaataccatacatgaattttccctatttttgaattttagataaatgtaatccatatagaatatcctcttttgtatgaggcttcttttattcaacatgtttgtgagatccatctatgttacttggagttgaggtttatttatcctttattgcatagtatcccattataagaatactacaacacggtgcaattacactactttagggtggacatttatttctagtttttggttcaaatacagctggtgtgactatttttatacaagtctcttggtgaacatatgtacacgcttctcctggacctaggaatggacaaagctttgttttgtatttttttaaatactctgaaaagaaaatgctatgtttttaaccattaacttgattaaaacattattacatttttaattatttaatcagaataactttcaaagatcatttcaagtctaacaaaaaaacataactttgttctttaataagtgtaatatttcctggaaatatgcctgggaatttttcttgaaataataagcgaatcttgacattaattggacattttcagaatgccctttggcgtgaagctatgtttcatgttttagaatgctcctctctaggtactttctttttaaccctgtccaatgtacttgacttttgttttctcactgagaaaatgaaagttcagaatgatttttttggggatagtaaggagactttgcataatgggaaataatggtcaggggaaaaccctttgttttataaggggccatttttgtatgctttttttactgaaacagagaaggtcaggttaattccatatccaaattaaatttatgattttcaaaagggaagccttgataatctaaccaaacgtgtccattatctaaagttatttggaaaattgtgtcactttaggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatataagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataa

SEQ ID NO: 319676 - DNA, 3447 bp, Homo sapiens
ggagggggcgtcgggaaagccccgacttcgcagccttacactcttcgtgggcggcgaccgcggccccactgacatcattcctcatgagggaggaggcacaaacagttctgggccgaccagaaaaaggacgactgggacttgactctgaatcgcaggatttgaagagatttctcctggcttcccaacgaggctggtgggaagcggtcctcctcccatacacgacctcccaccctcgcgaggcgtagaaaccagttctgactgtacagtaaagcgagggccagggctgaggtctggaagctaatgaaagcacagaaagtgtcgaaactggatgagcaggaagcgagtggcctcccctgtcatctgacgttttcccaggatgtaatttgcctgactgaaacagatcaggaccaacagggagagttttcgatttagtgtgaggaaaagagcactaaattgtagcaaaagaccttattgctcaaggcccagtcagaagatttcataaggaagctgtagaaagtcttaagaggaaatcagccgggcgtggtggcgggcacctgtaatcccagctactccggaggctgaggcaggagaatcgcttgaacccggggagcagaggttgcagtgagccgagatcgcgccactgtacgccagcctgggcgaaagaacgaaactccgtctccaaaaaaaaaaaaaacgaagaaaaagtccaaagagggtaaaggctgttctccccttaaaaaacagctaaagacctttgggggcgctgctccttgtaaatgtcaactacttccgcgggaaagaacgcgcaggcacttggccttgtgggcgctcacttgccccggaagtactgttgagttagcgcctcgccttccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatataagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaa

SEQ ID NO: 319677 - DNA, 2481 bp, Homo sapiens
acgttaatcacatccatgccagacaatgaattgtattaatggtcaggcatgaatattcgatgacttgagcatcaactccccatcagcgcttcaaatattgccgggatcaccctacggtcgtctggacagtgctacgttgactagtgcccaaggccgtcagttaaaaggtctcgagagtgagaagactctggctctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatataagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataa

SEQ ID NO: 319678 - DNA, 4707 bp, Homo sapiens
ggagggggcgtcgggaaagccccgacttcgcagccttacactcttcgtgggcggcgaccgcggccccactgacatcattcctcatgagggaggaggcacaaacagttctgggccgaccagaaaaaggacgactgggacttgactctgaatcgcaggatttgaagagatttctcctggcttcccaacgaggctggtgggaagcggtcctcctcccatacacgacctcccaccctcgcgaggcgtagaaaccagttctgactgtacagtaaagcgagggccagggctgaggtctggaagctaatgaaagcacagaaagtgtcgaaactggatgagcaggaagcgagtggcctcccctgtcatctgacgttttcccaggatgtaatttgcctgactgaaacagatcaggaccaacagggagagttttcgatttagtgtgaggaaaagagcactaaattgtagcaaaagaccttattgctcaaggcccagtcagaagatttcataaggaagctgtagaaagtcttaagaggaaatcagccgggcgtggtggcgggcacctgtaatcccagctactccggaggctgaggcaggagaatcgcttgaacccggggagcagaggttgcagtgagccgagatcgcgccactgtacgccagcctgggcgaaagaacgaaactccgtctccaaaaaaaaaaaaaacgaagaaaaagtccaaagagggtaaaggctgttctccccttaaaaaacagctaaagacctttgggggcgctgctccttgtaaatgtcaactacttccgcgggaaagaacgcgcaggcacttggccttgtgggcgctcacttgccccggaagtactgttgagttagcgcctcgccttccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagtgtatgttcagtgacttcctgacgaagcttaacattgtttcaattggcaaaggaaaaatattcgaagggtacagatccatgttcatggagccagcaaaaaggatgaagaagagcttggacacaaccgataactggcacatccgtccagaacccttctccctctcaatccctccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataa

SEQ ID NO: 319679 - DNA, 1794 bp, Homo sapiens
agcggcgccctttttttataccatgggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatataagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataa

SEQ ID NO: 319680 - DNA, 3023 bp, Homo sapiens
  misc_feature (1527)..(1527): n is a, c, g, or t
  misc_feature (2854)..(2854): n is a, c, g, or t
ggagggggcgtcgggaaagccccgacttcgcagccttacactcttcgtgggcggcgaccgcggccccactgacatcattcctcatgagggaggaggcacaaacagttctgggccgaccagaaaaaggacgactgggacttgactctgaatcgcaggatttgaagagatttctcctggcttcccaacgaggctggtgggaagcggtcctcctcccatacacgacctcccaccctcgcgaggcgtagaaaccagttctgactgtacagtaaagcgagggccagggctgaggtctggaagctaatgaaagcacagaaagtgtcgaaactggatgagcaggaagcgagtggcctcccctgtcatctgacgttttcccaggatgtaatttgcctgactgaaacagatcaggaccaacagggagagttttcgatttagtgtgaggaaaagagcactaaattgtagcaaaagaccttattgctcaaggcccagtcagaagatttcataaggaagctgtagaaagtcttaagaggaaatcagccgggcgtggtggcgggcacctgtaatcccagctactccggaggctgaggcaggagaatcgcttgaacccggggagcagaggttgcagtgagccgagatcgcgccactgtacgccagcctgggcgaaagaacgaaactccgtctccaaaaaaaaaaaaaacgaagaaaaagtccaaagagggtaaaggctgttctccccttaaaaaacagctaaagacctttgggggcgctgctccttgtaaatgtcaactacttccgcgggaaagaacgcgcaggcacttggccttgtgggcgctcacttgccccggaagtactgttgagttagcgcctcgccttccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagtgtatgttcagtgacttcctgacgaagcttaacattgtttcaattggcaaaggaaaaatattcgaagggtacagatccatgttcatggagccagcaaaaaggatgaagaagagcttggacacaaccgataactggcacatccgtccagaacccttctccctctcaatccctgtacactgcgggtttctccaaatgcctattgtctatgatttgttttgtccatcgttcttagtcacggcttagttcaggttcttgccatctttcacttgttccatcagccttctctctcatccagtctagttnctttgtttgtttgttttatcatttttaaattttttgtaaagacagggtcttgctttcttcaccaggctgatctcgaactcctggcctgaagcagtcctcccacctcagcctctcaaaagtgttgggattacaggctcgagccaccatgctaggccagtctatcttccttagttctccattttcttctataagacagaactaatcatgttacttagagaattaaattcaaacatggctcttcacagtttggccataacctatctctttaattttttctttccttgaattttttgagatattccagacccttggatggctttttgtttgcccccgtccctaagccgccttgatcatttttaatagcttaaaaagtacttttaagtattttatttcatcatgcctttaactgtcttttactatgtgctgtcatgttgtatgctaggatacgtagatgagtaaggcatgatctctgcctttgatccttactattaggaaataaggtgtattttatagttatgttagtattgagaaaatgaattctaagaatatgagttatagctaatttaaaaagtaccgtattcccagacatcagtccagagctatataatccgtgtccatgcctcttttaaaaaaaactttatttttagagacagggtctcccctttgtagcccaggctgaagtgcagtgatgctgtcatagctcactgcaacctccagctcctgggctcaaacatttctcctgagtagctggtgctgcgggtgcataccaccatgcccagctaatttttaaatttttcatcaagatgatgtcttaccatgttgctcaggctggtctcaaactcctggcctcaaacgatcttcccaccttagctgttttgggtttgagtaacatgtaattgttacttgcctttaagtgcctctctttcagctcatgtggacaagaaaataatccctatcctgttgtttaaaagtgggtatacacacatttttgtgatttttagacttttttgcctgattttcacacagttttgactttaattttcttctttattagaagatatgggtaactttagaacctctgagttcaaggaaggatctaagcaatgaggccagaggagtgagatgtcctatggtaaccaagcataccatttctttgtcaagtgggcttttgtttatggctgcttaggggcttaaaagctccatggactggtgaggattatcatttgaatggaatttccccaattcaagaaccttactattatcctccaatcagttctacactgttggggaaaatcccctggaccttatataacatactttgtaaccntgcagttagttactcttacactcttgtcattataaatgcttgatcaatagttgatagactagctcttgatcagagtacccttgtatggagagaaggaaaaaatgccatacatttcacttgattctgtgaaccataatgcttaggacagtagtggtttgggtttgattta

SEQ ID NO: 319681 - DNA, 4890 bp, Homo sapiens
ggagggggcgtcgggaaagccccgacttcgcagccttacactcttcgtgggcggcgaccgcggccccactgacatcattcctcatgagggaggaggcacaaacagttctgggccgaccagaaaaaggacgactgggacttgactctgaatcgcaggatttgaagagatttctcctggcttcccaacgaggctggtgggaagcggtcctcctcccatacacgacctcccaccctcgcgaggcgtagaaaccagttctgactgtacagtaaagcgagggccagggctgaggtctggaagctaatgaaagcacagaaagtgtcgaaactggatgagcaggaagcgagtggcctcccctgtcatctgacgttttcccaggatgtaatttgcctgactgaaacagatcaggaccaacagggagagttttcgatttagtgtgaggaaaagagcactaaattgtagcaaaagaccttattgctcaaggcccagtcagaagatttcataaggaagctgtagaaagtcttaagaggaaatcagccgggcgtggtggcgggcacctgtaatcccagctactccggaggctgaggcaggagaatcgcttgaacccggggagcagaggttgcagtgagccgagatcgcgccactgtacgccagcctgggcgaaagaacgaaactccgtctccaaaaaaaaaaaaaacgaagaaaaagtccaaagagggtaaaggctgttctccccttaaaaaacagctaaagacctttgggggcgctgctccttgtaaatgtcaactacttccgcgggaaagaacgcgcaggcacttggccttgtgggcgctcacttgccccggaagtactgttgagttagcgcctcgccttccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatataagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataaaaaaaaaaaaaaaaaaaaaaaaaaaaaaaataaaaggaaaaataagcccaaattaagacattatacataaatctgccgcaaggaggaggcctattgcgtttcatgacccctgacaggctagaagataatacttggacaactcattgggcaactgcattta

SEQ ID NO: 319682 - DNA, 4653 bp, Homo sapiens
  misc_feature (4653)..(4653): n is a, c, g, or t
ggagggggcgtcgggaaagccccgacttcgcagccttacactcttcgtgggcggcgaccgcggccccactgacatcattcctcatgagggaggaggcacaaacagttctgggccgaccagaaaaaggacgactgggacttgactctgaatcgcaggatttgaagagatttctcctggcttcccaacgaggctggtgggaagcggtcctcctcccatacacgacctcccaccctcgcgaggcgtagaaaccagttctgactgtacagtaaagcgagggccagggctgaggtctggaagctaatgaaagcacagaaagtgtcgaaactggatgagcaggaagcgagtggcctcccctgtcatctgacgttttcccaggatgtaatttgcctgactgaaacagatcaggaccaacagggagagttttcgatttagtgtgaggaaaagagcactaaattgtagcaaaagaccttattgctcaaggcccagtcagaagatttcataaggaagctgtagaaagtcttaagaggaaatcagccgggcgtggtggcgggcacctgtaatcccagctactccggaggctgaggcaggagaatcgcttgaacccggggagcagaggttgcagtgagccgagatcgcgccactgtacgccagcctgggcgaaagaacgaaactccgtctccaaaaaaaaaaaaaacgaagaaaaagtccaaagagggtaaaggctgttctccccttaaaaaacagctaaagacctttgggggcgctgctccttgtaaatgtcaactacttccgcgggaaagaacgcgcaggcacttggccttgtgggcgctcacttgccccggaagtactgttgagttagcgcctcgccttccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatataagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaataaatggttctttataagtgaaaaaaagan

SEQ ID NO: 319683 - DNA, 4529 bp, Homo sapiens
ggagggggcgtcgggaaagccccgacttcgcagccttacactcttcgtgggcggcgaccgcggccccactgacatcattcctcatgagggaggaggcacaaacagttctgggccgaccagaaaaaggacgactgggacttgactctgaatcgcaggatttgaagagatttctcctggcttcccaacgaggctggtgggaagcggtcctcctcccatacacgacctcccaccctcgcgaggcgtagaaaccagttctgactgtacagtaaagcgagggccagggctgaggtctggaagctaatgaaagcacagaaagtgtcgaaactggatgagcaggaagcgagtggcctcccctgtcatctgacgttttcccaggatgtaatttgcctgactgaaacagatcaggaccaacagggagagttttcgatttagtgtgaggaaaagagcactaaattgtagcaaaagaccttattgctcaaggcccagtcagaagatttcataaggaagctgtagaaagtcttaagaggaaatcagccgggcgtggtggcgggcacctgtaatcccagctactccggaggctgaggcaggagaatcgcttgaacccggggagcagaggttgcagtgagccgagatcgcgccactgtacgccagcctgggcgaaagaacgaaactccgtctccaaaaaaaaaaaaaacgaagaaaaagtccaaagagggtaaaggctgttctccccttaaaaaacagctaaagacctttgggggcgctgctccttgtaaatgtcaactacttccgcgggaaagaacgcgcaggcacttggccttgtgggcgctcacttgccccggaagtactgttgagttagcgcctcgccttccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatcttggagttatgacctacagtgatacagggaaactaagtccagaaacccaatctgccatcgaacaagaaataagaatccttctaagggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatataagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataa

SEQ ID NO: 319684 - DNA, 4526 bp, Homo sapiens
ggagggggcgtcgggaaagccccgacttcgcagccttacactcttcgtgggcggcgaccgcggccccactgacatcattcctcatgagggaggaggcacaaacagttctgggccgaccagaaaaaggacgactgggacttgactctgaatcgcaggatttgaagagatttctcctggcttcccaacgaggctggtgggaagcggtcctcctcccatacacgacctcccaccctcgcgaggcgtagaaaccagttctgactgtacagtaaagcgagggccagggctgaggtctggaagctaatgaaagcacagaaagtgtcgaaactggatgagcaggaagcgagtggcctcccctgtcatctgacgttttcccaggatgtaatttgcctgactgaaacagatcaggaccaacagggagagttttcgatttagtgtgaggaaaagagcactaaattgtagcaaaagaccttattgctcaaggcccagtcagaagatttcataaggaagctgtagaaagtcttaagaggaaatcagccgggcgtggtggcgggcacctgtaatcccagctactccggaggctgaggcaggagaatcgcttgaacccggggagcagaggttgcagtgagccgagatcgcgccactgtacgccagcctgggcgaaagaacgaaactccgtctccaaaaaaaaaaaaaacgaagaaaaagtccaaagagggtaaaggctgttctccccttaaaaaacagctaaagacctttgggggcgctgctccttgtaaatgtcaactacttccgcgggaaagaacgcgcaggcacttggccttgtgggcgctcacttgccccggaagtactgttgagttagcgcctcgccttccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggtatctcaataaaataaagtttgatcaatccgttgatccagaaattatagctcgaggtactgttggcttttccggagcagagttggagaatcttgtgaaccaggctgcattaaaagcagctgttgatggaaaagaaatggttaccatgaaggagctggagttttccaaagacaaaattctaatggggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtgtccctgttacctgagaatgacagatggaatgaaactagagcccagctgcttgcacaaatggatgttagtatgggaggaagagtggcagaggagcttatatttggaaccgaccatattacaacaggtgcttccagtgattttgataatgccactaaaatagcaaagcggatggttaccaaatttggaatgagtgaaaagcttggagttatgacctacagtgatacagggaaactaagtccagaaacccaatctgccatcgaacaagaatataagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataa

SEQ ID NO: 319685 - DNA, 4105 bp, Homo sapiens
ggagggggcgtcgggaaagccccgacttcgcagccttacactcttcgtgggcggcgaccgcggccccactgacatcattcctcatgagggaggaggcacaaacagttctgggccgaccagaaaaaggacgactgggacttgactctgaatcgcaggatttgaagagatttctcctggcttcccaacgaggctggtgggaagcggtcctcctcccatacacgacctcccaccctcgcgaggcgtagaaaccagttctgactgtacagtaaagcgagggccagggctgaggtctggaagctaatgaaagcacagaaagtgtcgaaactggatgagcaggaagcgagtggcctcccctgtcatctgacgttttcccaggatgtaatttgcctgactgaaacagatcaggaccaacagggagagttttcgatttagtgtgaggaaaagagcactaaattgtagcaaaagaccttattgctcaaggcccagtcagaagatttcataaggaagctgtagaaagtcttaagaggaaatcagccgggcgtggtggcgggcacctgtaatcccagctactccggaggctgaggcaggagaatcgcttgaacccggggagcagaggttgcagtgagccgagatcgcgccactgtacgccagcctgggcgaaagaacgaaactccgtctccaaaaaaaaaaaaaacgaagaaaaagtccaaagagggtaaaggctgttctccccttaaaaaacagctaaagacctttgggggcgctgctccttgtaaatgtcaactacttccgcgggaaagaacgcgcaggcacttggccttgtgggcgctcacttgccccggaagtactgttgagttagcgcctcgccttccggggcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagtgagccttcacttaacttaagggaccttggattatctgaactaaaaattggacagattgatcagctggtagaaaatctacttcctggattttgtaaaggcaaaaacatttcttcccattggcatacatcccatgtctctgcacaatccttctttgaaaataaatatggtaacttagatatatttagtacattacgttcctcttgcttgtatcgacatcattcaagagctcttcaaagcatttgttcagatcttcagtactggccagttttcatacagtctcggggttttaaaactttgaaatcaaggacacgacgtctccagtctacctccgagagattagctgaaacacagaatatagcgccatcattcgtgaaggggtttcttttgcgggacagaggatcagatgttgagagtttggacaaactcatgaaaaccaaaaatatacctgaagctcaccaagatgcatttaaaactggttttgcggaaggttttctgaaagctcaagcactcacacaaaaaaccaatgattccctaaggcgaacccgtctgattctcttcgttctgctgctattcggcatttatggacttctaaaaaacccatttttatctgtccgcttccggacaacaacagggcttgattctgcagtagatcctgtccagatgaaaaatgtcacctttgaacatgttaaaggggtggaggaagctaaacaagaattacaggaagttgttgaattcttgaaaaatccacaaaaatttactattcttggaggtaaacttccaaaaggaattcttttagttggacccccagggactggaaagacacttcttgcccgagctgtggcgggagaagctgatgttcctttttattatgcttctggatccgaatttgatgagatgtttgtgggtgtgggagccagccgtatcagaaatctttttagggaagcaaaggcgaatgctccttgtgttatatttattgatgaattagattctgttggtgggaagagaattgaatctccaatgcatccatattcaaggcagaccataaatcaacttcttgctgaaatggatggttttaaacccaatgaaggagttatcataataggagccacaaacttcccagaggcattagataatgccttaatacgtcctggtcgttttgacatgcaagttacagttccaaggccagatgtaaaaggtcgaacagaaattttgaaatggactcatatgaacgagcaaaacatatcttgaaaactcatgcaaaggagcataagaatctcgcagaagctttattgacctatgagactttggatgccaaagagattcaaattgttcttgaggggaaaaagttggaagtgagatgataactctcttgatatggatgcttgctggttttattgcaagaatataagtagcattgcagtagtctacttttacaacgctttcccctcattcttgatgtggtgtaattgaagggtgtgaaatgctttgtcaatcatttgtcacatttatccagtttgggttattctcattatgacacctattgcaaattagcatcccatggcaaatatattttgaaaaaataaagaactatcaggattgaaaacagctcttttgaggaatgtcaattagttattaagttgaaagtaattaatgattttatgtttggttactctactagatttgataaaaattgtgcctttagccttctatatacatcagtggaaacttaagatgcagtaattatgttccagattgaccatgaataaaatattttttaatctaaatgtagagaagttgggattaaaagcagtctcggaaacacagagccaggaatatagccttttggcatggtgccatggctcacatctgtaatcccagcacttttggaggctgaggcgggtggattgcttgaggccaggagttcgagaccagcctggccaacgtggtgaaacgctgtctctactaaaatacaaaaaaatagggctgggcgcggttgctcacgcctgtaatcccagcacttttcagaggccaaggcgggcaaatcacctgaggtcaagagtttgagaccagcctggccaacatggtgaaaccccatctctactaaacatgcaaaaattacctgggcatggtggcaggtgcttataatcccagctactctgggggccaaggcaggagaattgcttgagcctgggagatggaggttgcagtgagctgagatcatgccactgcactccagcctgggcaacagagcaagactctgcctcaaaaaaaaattaaaataaatttaaatacaaaaaaaaatagccaggtgtggggtgcatgcctggaatcccagctacttgagaggctgaggcacgagaattgcttgaacccaggaggtggaggttgcagtgagccaagatcacaggagccactgcactccagcctgggtgacagagtgagactctgtctcaaaaaaaaattaaataaattattataacctttcagaaatgctgtgtgcattttcatgttcttttttttagcattactgtcactctccctaatgaaatgtacttcagagaagcagtattttgttaaataaatacataacctcattctgaataatgtccctcattttgactataactgtgcttggtttcaaaagcaaaattaaacaaaaatctcagtcccctccgaagtgaactttgtgttaccctgcgtcagaaatgccaagttgtgtttacttttcattcagattttgtgaatatgaacatgctgttataggatctacagatgaatatttaactcaatagaaaaattattttagaacacattgtattggtattacaaccagattatattcttgacgttgacttcattaaaattatctacaatttcctaataa

SEQ ID NO: 319686 - DNA, 6627 bp, Homo sapiens
cccaaatctattaaagcagcaccctgataccacttactctgttgcattgttatgaagacttaaggtaacagagctaaacaccagtgcactgcctgtaacagagtgagcacacaataacttacagctcttactgtttacagtgataaccagctacttaatacctggctcatgtttccatgtgccacttgtttcttggtaacaaacaagagtcatggaaatcatgggatgtacagtcagaatggtttcccttgtcctagaatttggataaacctaatgaaatataaaagcaagttgagtttccctagttctgggtggcagggtcctatttaagagagagaagggaatggggaagataagcccagcattactttccaccggctccatccaggagtaaggccaggtgactttggggatgccagttggtgggtagagagcagcgtggctgtgtgcagtgggtaccagcgtggcctggcaccctgggcttcatgctgtgcttcctctggaggcctgggctgagacagtgctcttggtatcctgtgctagattcctaacactgattagtagcatctcttctggcctctggtgtgcttggcttccctaggcatgcagtaccataagctgacagagcacttcgatgagaagcctttctcctgtgaagagtgtggggcgaagtttgcagccaattccaccctgaagaaccaccttcgccttcacaccggggaccgcccgttcatgtgcaagcactgcctcatgaccttcacccaggcctccgccctggcctatcacaccaagaagaagcactcagaagggaaaatgtatgcatgccagtactgtgatgctgtgtttgcccagtctattgagctgtcccgccacgtgaggacccacaccggggacaagccctatgtctgcagagactgtggcaagggcttccggcaagccaatggcctctccatccatctgcacacctttcacaacatagaagatccttatgactgcaagaagtgcaggatgagtttccccactcttcaggatcaccggaagcacatccatgaggtgcactccaaagagtaccacccctgccccacgtgtgggaagatcttcagtgccccgtccatgctggagcggcacatggtgacccacgttggagggaagcccttcagctgcgggatctgcaacaaggcctaccagcaattgtctggtttgtggtaccacaatcgaacccaccaccctgacgtatttgctgctcagaaccaccgatcttccaagttctcatcactccagtgcagctcctgtgacaaaaccttccccaacaccattgagcacaagaagcacatcaaagcagaacatgcagatatgaagttccatgaatgtgaccagtgtaaggagctcttccccacgccagccttgctgcaggttcatgtcaagtgccagcattcagggtcccagccattccggtgcttgtactgtgctgctactttccgttttcctggagcattgcagcaccatgtcaccacggagcacttcaagcagtcagagaccaccttcccctgtgagctctgtggggaactcttcacctcccaggcccagcttgacagtcacctggaatctgagcacccaaaggtgatgagcacggaaacccaggccgcagcctcacagatggcgcaggtgatccaaaccccagagccggtggccccgacagagcaggtgatcactttggaggagacccagcttgccgggtcgcaggtgtttgtgacgttgccagattctcaggcatctcaggccagctctgagctcgtggcggtgactgtggaggacttgctggatggcacagtgacgctgatctgtggtgaggccaaatgagcagcctttcatccggcagagccttcctgcgtttgcagcagagaggaggccccacagcttgccctttgccctccatccctggctgtcctgagtggtgagcatcttagcttagcaccaaccaacacagtctcacctagaaaacagatggaagcttcgttgttctcatagaaccaacagcatctgagccctcaacaccaacagcaccatcctctgtagcagacaggcctccctccccacaggcccgctgctgcggcctctatgacactgtccatccccaagtgacatgtggcttcagaagtagagtctgaaagagcagtgggatgggagctggtgaccagggtaccccaggaggcatgatgtgccgacagcgctcagtgggcagaatggcagttagatatgggacttggcccacagtgggggctgcaaatgctgccactgcctctggccatttaaagtgagaggggcaccaacagacaattcggggaccttaggccccttcctgaggcacacttggccccttcctcggtcctatcatcctaccctctgctggggttccccctccacccagtggccacgcccagcaccctattgatggctataggacaggtagccctcatttccatgcctgataaccccttgtcagttgtcagctcttcccaaaacaaagctctggagtttctgctggaagtgtttaatgtgaggcatcagctgctagacagtgtctgcctttccaggacattcttcttggtattccttacctgaagcctggttcccacagctcttccgtgtcatcttcatccccttcctttaatcaaaggctgaaatctctgcctgacctggcagcctggctccctctgggtcatatggtgcagactgtgaccagcaccaggcaggcagtcctgtctgcgtgtggaggagcagccgtgactgcccgtggctctgctgccgcccactccctgccttgtgagtggcctgctgcctcacctcccgcaggccgccacacttattgcaggtcagtgatcctttggagtttgaatttcacaaagctttttttatcttcagttcctaaaatataatctgataattaatggtttgtggaatccattatgaagtgcaattagatagatgtaggttcctgccgtttggagagaatgactagcatttatcttcttttccttccatgccaaaggttggagtctgctggtgcggtgtttacacaccaggcagggctgtctgccaccttgtgtggcttgaccccctgtggaggggagtgcctggttggatcccacactggcagagatggggccaccccttccttccaggcacatctcacattgccatgtacagaggcaggagtcacgtttggtcaccatggaagcttttattgctcccacatggtcaggtctcaccctgcttgaagcgcagaaggcacagccttactgaccagcacgcccactgactggcatctgccggctttgtgcaggcagccccgacggtttccacagcgagcgccagctccggccagcctgggacagctcatcccagccgactacacctgcttctggtcctgtccacattttgatacgcagatcacttgagcttgtcaattagggttctgccattctgaaataaatgaagtttctaaagcagagtcggcctcagaagccaaaaactgaccagaagatggtgctcaaacctttaagacttcatctccatgtgaagggctcactgtttctaccaaggctgtgcctgtattaaggcttttccgtcctgggaactgtcagtctgggagagctcttgatctgcaggtggcaaaatggcactgaatatccccttggcagcagagaaaacccactgaaagatcgtagagtggcacatgcttacagggcattggtgccaagtccagtggatgagaatccagcccctcacaagctgtgggatggggcttgggagttgcagtgaatgtcattaaaatttcttccaaaacaaaactagaaataattgctgagggcttatagggaagtgatttaaaaagaaaaaacaaacaacaacaaaaaaaactcttcggaataaagagggctgtaaattttgaattccagtgtcagatcctttcaagcactgagaaattctttctcaggtttctttttttgggggagacagggtcttgctctgtcacccagactggaacacagtggcacgatcttggctcactgcaacctctgcgggctcacgcaatcctcctgccacagcttcccaagtagctgggaccacaggcgtgagccaccactgctggccagtttttgtatttttttttttttttgtagagacagggtctcgccatgttgcccaggctggtttaaaactcctgagctcaagcagttctcccacctgggcctcccaaagtgctaggattacagacatgagccactacgcctggccaggtttctgttggagacccagattgtgacaagacatttgttttcttcggaatcaccagatttgcagcttactgtgccgagagtggactggctgccggggcccatcagatgccctctggcccatggcacactcagcagaaggcacaaacccagtgctggttctcatcaagaaagaggggaaggcccttcccgagtttactgtctgctctgagtgggctccgcactggctgactgattttatagtcttgctctctagagaagcccaggcatggatcttataggaaaactttctgactctgcttggccattttatccttttctcctacttctgcccaagagacctgaattgctgccatagaggacagtgtttgtgtggtctcctgagtccacatcgctcgcttccatggggtcccggtgttgtttttgcctcgttccccataggctgctgcccttatggcctctggactgaactctggggcctttggggtggtgtgaaggagtctgtgggcttcttggaacacatggatctgttcggtgggtccccagacctctgctcccagagctcatggcccaggtggtgaggagggaaaggcagtcagattccaggctggagtgtgattctgtgggaatactggggtcagttatggaacaggacttgcccatcataggtaagtgagacagcaaatagatgattcaagagcaaggattactgcgggaaggtgagactcctactgtccacgcgcatgagcagaacctggaaccagaggggcagggaccaggggtctttactcatttattttatgggtaaagagacatgaagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaagaaatccagtcagacagacagtggggagacaggtccctgccctttatttgcgggatcaatcagggactcccagaaaggaaggagaatggtgagaagggccctaagagttcgtctctcacctgggggctggtgacgtggtcaccacaagctgaagacaggctaatggggtggcgggtgtgtgtttaaacctcacgtgcctggaagctgcacattgaccaaaggagggagggaagtgctaaccatgtatagagtgggcaggcggttccagggagacaagcagcatgttattaaattgggcctaggcagttggacgataatggagaaaaagcagggatgctataatgagtcctccccaagggtgagttcagcaccccagccctgttctgcttgtatcccagtgatacttgggaggtaggaagaaaatgggagtaagagaacaatttggggctgaagggagtgtcagaggcacgttgatccttgttttgttgtcatggaaacttcggggctggtgggacttaggccaaaagctcagaggcacagccaaaatttagaagcttgctactcctacgactcggcctataaggaagagagaagctgtctgtactttggggactacattgctgaaggaaaaaaatcactccctggctaattaagattgcttccaaattgggggaatgtgtgtcatttcctttaccaaggccagtcatccctgcttccacccatggtcaggacagtcagccactacgtgatgctgtataaattggattacaaaccatattcttgttcagcttgcactaatctatataaataaaatatgtactttgaaaaaaattaggctacatgagtttcaaatggactgtgatgttatagacctgctttctctttggttctgggccagtgtcagacggggacaggggtgataggcctggtgtcctaggggccatttgtgtaccttgaggccgtgttaacatggcctgggggaaagaaagctctcctgtcacttggagtctcattcctaaaccctccttcccagggagcaagtgtggggcagggtttcagagcacaggctttggtgtccagcctgggtacatccagctgtcccgctgtctaactgacattgtgtgagatgcttactctctctgagctccctcctcctggctcccaactttattataaaatggggaaaatgattgtgcttgccctacagaattgtagtatgaattaaaagtctggatttaatgtatttaatatagaaaattttagcttttattaataaaagtttttggcatacaaaaaaactat

SEQ ID NO: 319687 - DNA, 6278 bp, Homo sapiens
tctgtaaggcctgcgacaaaagcttccatttctactgccgcctaaaggtgcacatgaagcgctgccgggtggctaagagcaaacaggtgcagtgtaaggagtgcagtgagaccaaggattcaaagaaagagctggacaaacatcagctggaggcccatggtgcaggtggagagcccgatgcccccaagaagaagaagaagaggcttccagtgacatgtgacctctgtggcagagaatttgcccatgcctcaggcatgcagtaccataagctgacagagcacttcgatgagaagcctttctcctgtgaagagtgtggggcgaagtttgcagccaattccaccctgaagaaccaccttcgccttcacaccggggaccgcccgttcatgtgcaagcactgcctcatgaccttcacccaggcctccgccctggcctatcacaccaagaagaagcactcagaagggaaaatgtatgcatgccagtactgtgatgctgtgtttgcccagtctattgagctgtcccgccacgtgaggacccacaccggggacaagccctatgtctgcagagactgtggcaagggcttccggcaagccaatggcctctccatccatctgcacacctttcacaacatagaagatccttatgactgcaagaagtgcaggatgagtttccccactcttcaggatcaccggaagcacatccatgaggtgcactccaaagagtaccacccctgccccacgtgtgggaagatcttcagtgccccgtccatgctggagcggcacatggtgacccacgttggagggaagcccttcagctgcgggatctgcaacaaggcctaccagcaattgtctggtttgtggtaccacaatcgaacccaccaccctgacgtatttgctgctcagaaccaccgatcttccaagttctcatcactccagtgcagctcctgtgacaaaaccttccccaacaccattgagcacaagaagcacatcaaagcagaacatgcagatatgaagttccatgaatgtgaccagtgtaaggagctcttccccacgccagccttgctgcaggttcatgtcaagtgccagcattcagggtcccagccattccggtgcttgtactgtgctgctactttccgttttcctggagcattgcagcaccatgtcaccacggagcacttcaagcagtcagagaccaccttcccctgtgagctctgtggggaactcttcacctcccaggcccagcttgacagtcacctggaatctgagcacccaaaggtgatgagcacggaaacccaggccgcagcctcacagatggcgcaggtgatccaaaccccagagccggtggccccgacagagcaggtgatcactttggaggagacccagcttgccgggtcgcaggtgtttgtgacgttgccagattctcaggcatctcaggccagctctgagctcgtggcggtgactgtggaggacttgctggatggcacagtgacgctgatctgtggtgaggccaaatgagcagcctttcatccggcagagccttcctgcgtttgcagcagagaggaggccccacagcttgccctttgccctccatccctggctgtcctgagtggtgagcatcttagcttagcaccaaccaacacagtctcacctagaaaacagatggaagcttcgttgttctcatagaaccaacagcatctgagccctcaacaccaacagcaccatcctctgtagcagacaggcctccctccccacaggcccgctgctgcggcctctatgacactgtccatccccaagtgacatgtggcttcagaagtagagtctgaaagagcagtgggatgggagctggtgaccagggtaccccaggaggcatgatgtgccgacagcgctcagtgggcagaatggcagttagatatgggacttggcccacagtgggggctgcaaatgctgccactgcctctggccatttaaagtgagaggggcaccaacagacaattcggggaccttaggccccttcctgaggcacacttggccccttcctcggtcctatcatcctaccctctgctggggttccccctccacccagtggccacgcccagcaccctattgatggctataggacaggtagccctcatttccatgcctgataaccccttgtcagttgtcagctcttcccaaaacaaagctctggagtttctgctggaagtgtttaatgtgaggcatcagctgctagacagtgtctgcctttccaggacattcttcttggtattccttacctgaagcctggttcccacagctcttccgtgtcatcttcatccccttcctttaatcaaaggctgaaatctctgcctgacctggcagcctggctccctctgggtcatatggtgcagactgtgaccagcaccaggcaggcagtcctgtctgcgtgtggaggagcagccgtgactgcccgtggctctgctgccgcccactccctgccttgtgagtggcctgctgcctcacctcccgcaggccgccacacttattgcaggtcagtgatcctttggagtttgaatttcacaaagctttttttatcttcagttcctaaaatataatctgataattaatggtttgtggaatccattatgaagtgcaattagatagatgtaggttcctgccgtttggagagaatgactagcatttatcttcttttccttccatgccaaaggttggagtctgctggtgcggtgtttacacaccaggcagggctgtctgccaccttgtgtggcttgaccccctgtggaggggagtgcctggttggatcccacactggcagagatggggccaccccttccttccaggcacatctcacattgccatgtacagaggcaggagtcacgtttggtcaccatggaagcttttattgctcccacatggtcaggtctcaccctgcttgaagcgcagaaggcacagccttactgaccagcacgcccactgactggcatctgccggctttgtgcaggcagccccgacggtttccacagcgagcgccagctccggccagcctgggacagctcatcccagccgactacacctgcttctggtcctgtccacattttgatacgcagatcacttgagcttgtcaattagggttctgccattctgaaataaatgaagtttctaaagcagagtcggcctcagaagccaaaaactgaccagaagatggtgctcaaacctttaagacttcatctccatgtgaagggctcactgtttctaccaaggctgtgcctgtattaaggcttttccgtcctgggaactgtcagtctgggagagctcttgatctgcaggtggcaaaatggcactgaatatccccttggcagcagagaaaacccactgaaagatcgtagagtggcacatgcttacagggcattggtgccaagtccagtggatgagaatccagcccctcacaagctgtgggatggggcttgggagttgcagtgaatgtcattaaaatttcttccaaaacaaaactagaaataattgctgagggcttatagggaagtgatttaaaaagaaaaaacaaacaacaacaaaaaaaactcttcggaataaagagggctgtaaattttgaattccagtgtcagatcctttcaagcactgagaaattctttctcaggtttctttttttgggggagacagggtcttgctctgtcacccagactggaacacagtggcacgatcttggctcactgcaacctctgcgggctcacgcaatcctcctgccacagcttcccaagtagctgggaccacaggcgtgagccaccactgctggccagtttttgtatttttttttttttttgtagagacagggtctcgccatgttgcccaggctggtttaaaactcctgagctcaagcagttctcccacctgggcctcccaaagtgctaggattacagacatgagccactacgcctggccaggtttctgttggagacccagattgtgacaagacatttgttttcttcggaatcaccagatttgcagcttactgtgccgagagtggactggctgccggggcccatcagatgccctctggcccatggcacactcagcagaaggcacaaacccagtgctggttctcatcaagaaagaggggaaggcccttcccgagtttactgtctgctctgagtgggctccgcactggctgactgattttatagtcttgctctctagagaagcccaggcatggatcttataggaaaactttctgactctgcttggccattttatccttttctcctacttctgcccaagagacctgaattgctgccatagaggacagtgtttgtgtggtctcctgagtccacatcgctcgcttccatggggtcccggtgttgtttttgcctcgttccccataggctgctgcccttatggcctctggactgaactctggggcctttggggtggtgtgaaggagtctgtgggcttcttggaacacatggatctgttcggtgggtccccagacctctgctcccagagctcatggcccaggtggtgaggagggaaaggcagtcagattccaggctggagtgtgattctgtgggaatactggggtcagttatggaacaggacttgcccatcataggtaagtgagacagcaaatagatgattcaagagcaaggattactgcgggaaggtgagactcctactgtccacgcgcatgagcagaacctggaaccagaggggcagggaccaggggtctttactcatttattttatgggtaaagagacatgaagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaagaaatccagtcagacagacagtggggagacaggtccctgccctttatttgcgggatcaatcagggactcccagaaaggaaggagaatggtgagaagggccctaagagttcgtctctcacctgggggctggtgacgtggtcaccacaagctgaagacaggctaatggggtggcgggtgtgtgtttaaacctcacgtgcctggaagctgcacattgaccaaaggagggagggaagtgctaaccatgtatagagtgggcaggcggttccagggagacaagcagcatgttattaaattgggcctaggcagttggacgataatggagaaaaagcagggatgctataatgagtcctccccaagggtgagttcagcaccccagccctgttctgcttgtatcccagtgatacttgggaggtaggaagaaaatgggagtaagagaacaatttggggctgaagggagtgtcagaggcacgttgatccttgttttgttgtcatggaaacttcggggctggtgggacttaggccaaaagctcagaggcacagccaaaatttagaagcttgctactcctacgactcggcctataaggaagagagaagctgtctgtactttggggactacattgctgaaggaaaaaaatcactccctggctaattaagattgcttccaaattgggggaatgtgtgtcatttcctttaccaaggccagtcatccctgcttccacccatggtcaggacagtcagccactacgtgatgctgtataaattggattacaaaccatattcttgttcagcttgcactaatctatataaataaaatatgtactttgaaaaaaattaggctacatgagtttcaaatggactgtgatgttatagacctgctttctctttggttctgggccagtgtcagacggggacaggggtgataggcctggtgtcctaggggccatttgtgtaccttgaggccgtgttaacatggcctgggggaaagaaagctctcctgtcacttggagtctcattcctaaaccctccttcccagggagcaagtgtggggcagggtttcagagcacaggctttggtgtccagcctgggtacatccagctgtcccgctgtctaactgacattgtgtgagatgcttactctctctgagctccctcctcctggctcccaactttattataaaatggggaaaatgattgtgcttgccctacagaattgtagtatgaattaaaagtctggatttaatgtatttaatatagaaaattttagcttttattaataaaagtttttggcatacaaaaaaactat

SEQ ID NO: 319688 - DNA, 6231 bp, Homo sapiens
tctgtaaggcctgcgacaaaagcttccatttctactgccgcctaaaggtgcacatgaagcgctgccgggtggctaagagcaaacaggtgcagtgtaaggagtgcagtgagaccaaggattcaaagaaagagctggacaaacatcagctggaggcccatggtgcaggtggagagcccgatgcccccaagaagaagaagaagaggcttccagtgacatgtgacctctgtggcagagaatttgcccatgcctcaggcatgcagtaccataagctgacagagcacttcgatgagaagcctttctcctgtgaagagtgtggggcgaagtttgcagccaattccaccctgaagaaccaccttcgccttcacaccggggaccgcccgttcatgtgcaagcactgcctcatgaccttcacccaggcctccgccctggcctatcacaccaagaagaagcactcagaagggaaaatgtatgcatgccagtactgtgatgctgtgtttgcccagtctattgagctgtcccgccacgtgaggacccacaccggggacaagccctatgtctgcagagactgtggcaagggcttccggcaagccaatggcctctccatccatctgcacacctttcacaacatagaagatccttatgactgcaagaagtgcaggatgagtttccccactcttcaggatcaccggaagcacatccatgaggtgcactccaaagagtaccacccctgccccacgtgtgggaagatcttcagtgccccgtccatgctggagcggcacatggtgacccacgttggagggaagcccttcagctgcgggatctgcaacaaggcctaccagcaattgtctggtttgtggtaccacaatcgaacccaccaccctgacgtatttgctgctcagaaccaccgatcttccaagttctcatcactccagtgcagctcctgtgacaaaaccttccccaacaccattgagcacaagaagcacatcaaagcagaacatgcagatatgaagttccatgaatgtgaccagtgtaaggagctcttccccacgccagccttgctgcaggttcatgtcaagtgccagcattcagggtcccagccattccggtgcttgtactgtgctgctactttccgttttcctggagcattgcagcaccatgtcaccacggagcacttcaagcagtcagagaccaccttcccctgtgagctctgtggggaactcttcacctcccaggcccagcttgacagtcacctggaatctgagcacccaaaggtgatgagcacggaaacccaggccgcagcctcacagatggcgcagtttggaggagacccagcttgccgggtcgcaggtgtttgtgacgttgccagattctcaggcatctcaggccagctctgagctcgtggcggtgactgtggaggacttgctggatggcacagtgacgctgatctgtggtgaggccaaatgagcagcctttcatccggcagagccttcctgcgtttgcagcagagaggaggccccacagcttgccctttgccctccatccctggctgtcctgagtggtgagcatcttagcttagcaccaaccaacacagtctcacctagaaaacagatggaagcttcgttgttctcatagaaccaacagcatctgagccctcaacaccaacagcaccatcctctgtagcagacaggcctccctccccacaggcccgctgctgcggcctctatgacactgtccatccccaagtgacatgtggcttcagaagtagagtctgaaagagcagtgggatgggagctggtgaccagggtaccccaggaggcatgatgtgccgacagcgctcagtgggcagaatggcagttagatatgggacttggcccacagtgggggctgcaaatgctgccactgcctctggccatttaaagtgagaggggcaccaacagacaattcggggaccttaggccccttcctgaggcacacttggccccttcctcggtcctatcatcctaccctctgctggggttccccctccacccagtggccacgcccagcaccctattgatggctataggacaggtagccctcatttccatgcctgataaccccttgtcagttgtcagctcttcccaaaacaaagctctggagtttctgctggaagtgtttaatgtgaggcatcagctgctagacagtgtctgcctttccaggacattcttcttggtattccttacctgaagcctggttcccacagctcttccgtgtcatcttcatccccttcctttaatcaaaggctgaaatctctgcctgacctggcagcctggctccctctgggtcatatggtgcagactgtgaccagcaccaggcaggcagtcctgtctgcgtgtggaggagcagccgtgactgcccgtggctctgctgccgcccactccctgccttgtgagtggcctgctgcctcacctcccgcaggccgccacacttattgcaggtcagtgatcctttggagtttgaatttcacaaagctttttttatcttcagttcctaaaatataatctgataattaatggtttgtggaatccattatgaagtgcaattagatagatgtaggttcctgccgtttggagagaatgactagcatttatcttcttttccttccatgccaaaggttggagtctgctggtgcggtgtttacacaccaggcagggctgtctgccaccttgtgtggcttgaccccctgtggaggggagtgcctggttggatcccacactggcagagatggggccaccccttccttccaggcacatctcacattgccatgtacagaggcaggagtcacgtttggtcaccatggaagcttttattgctcccacatggtcaggtctcaccctgcttgaagcgcagaaggcacagccttactgaccagcacgcccactgactggcatctgccggctttgtgcaggcagccccgacggtttccacagcgagcgccagctccggccagcctgggacagctcatcccagccgactacacctgcttctggtcctgtccacattttgatacgcagatcacttgagcttgtcaattagggttctgccattctgaaataaatgaagtttctaaagcagagtcggcctcagaagccaaaaactgaccagaagatggtgctcaaacctttaagacttcatctccatgtgaagggctcactgtttctaccaaggctgtgcctgtattaaggcttttccgtcctgggaactgtcagtctgggagagctcttgatctgcaggtggcaaaatggcactgaatatccccttggcagcagagaaaacccactgaaagatcgtagagtggcacatgcttacagggcattggtgccaagtccagtggatgagaatccagcccctcacaagctgtgggatggggcttgggagttgcagtgaatgtcattaaaatttcttccaaaacaaaactagaaataattgctgagggcttatagggaagtgatttaaaaagaaaaaacaaacaacaacaaaaaaaactcttcggaataaagagggctgtaaattttgaattccagtgtcagatcctttcaagcactgagaaattctttctcaggtttctttttttgggggagacagggtcttgctctgtcacccagactggaacacagtggcacgatcttggctcactgcaacctctgcgggctcacgcaatcctcctgccacagcttcccaagtagctgggaccacaggcgtgagccaccactgctggccagtttttgtatttttttttttttttgtagagacagggtctcgccatgttgcccaggctggtttaaaactcctgagctcaagcagttctcccacctgggcctcccaaagtgctaggattacagacatgagccactacgcctggccaggtttctgttggagacccagattgtgacaagacatttgttttcttcggaatcaccagatttgcagcttactgtgccgagagtggactggctgccggggcccatcagatgccctctggcccatggcacactcagcagaaggcacaaacccagtgctggttctcatcaagaaagaggggaaggcccttcccgagtttactgtctgctctgagtgggctccgcactggctgactgattttatagtcttgctctctagagaagcccaggcatggatcttataggaaaactttctgactctgcttggccattttatccttttctcctacttctgcccaagagacctgaattgctgccatagaggacagtgtttgtgtggtctcctgagtccacatcgctcgcttccatggggtcccggtgttgtttttgcctcgttccccataggctgctgcccttatggcctctggactgaactctggggcctttggggtggtgtgaaggagtctgtgggcttcttggaacacatggatctgttcggtgggtccccagacctctgctcccagagctcatggcccaggtggtgaggagggaaaggcagtcagattccaggctggagtgtgattctgtgggaatactggggtcagttatggaacaggacttgcccatcataggtaagtgagacagcaaatagatgattcaagagcaaggattactgcgggaaggtgagactcctactgtccacgcgcatgagcagaacctggaaccagaggggcagggaccaggggtctttactcatttattttatgggtaaagagacatgaagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaagaaatccagtcagacagacagtggggagacaggtccctgccctttatttgcgggatcaatcagggactcccagaaaggaaggagaatggtgagaagggccctaagagttcgtctctcacctgggggctggtgacgtggtcaccacaagctgaagacaggctaatggggtggcgggtgtgtgtttaaacctcacgtgcctggaagctgcacattgaccaaaggagggagggaagtgctaaccatgtatagagtgggcaggcggttccagggagacaagcagcatgttattaaattgggcctaggcagttggacgataatggagaaaaagcagggatgctataatgagtcctccccaagggtgagttcagcaccccagccctgttctgcttgtatcccagtgatacttgggaggtaggaagaaaatgggagtaagagaacaatttggggctgaagggagtgtcagaggcacgttgatccttgttttgttgtcatggaaacttcggggctggtgggacttaggccaaaagctcagaggcacagccaaaatttagaagcttgctactcctacgactcggcctataaggaagagagaagctgtctgtactttggggactacattgctgaaggaaaaaaatcactccctggctaattaagattgcttccaaattgggggaatgtgtgtcatttcctttaccaaggccagtcatccctgcttccacccatggtcaggacagtcagccactacgtgatgctgtataaattggattacaaaccatattcttgttcagcttgcactaatctatataaataaaatatgtactttgaaaaaaattaggctacatgagtttcaaatggactgtgatgttatagacctgctttctctttggttctgggccagtgtcagacggggacaggggtgataggcctggtgtcctaggggccatttgtgtaccttgaggccgtgttaacatggcctgggggaaagaaagctctcctgtcacttggagtctcattcctaaaccctccttcccagggagcaagtgtggggcagggtttcagagcacaggctttggtgtccagcctgggtacatccagctgtcccgctgtctaactgacattgtgtgagatgcttactctctctgagctccctcctcctggctcccaactttattataaaatggggaaaatgattgtgcttgccctacagaattgtagtatgaattaaaagtctggatttaatgtatttaatatagaaaattttagcttttattaataaaagtttttggcatacaaaaaaactat

SEQ ID NO: 319689 - DNA, 262 bp, Homo sapiens
aatggagggaggaaaaaatcaaggttttgctccagaagcctgaagtcctcccaggagggagtgaggcgtctctatccacacagagagcatctgcagacaggagccatgggggagtagtggtgagtatcctaaaaactcaattccagccaaggactgccacctccacttaaccctctgggtcccctggcaggtgggactatggctccatgtttcagaggggacaagcagggctgggggtcacctctgctccaggatatcctcc

SEQ ID NO: 319690 - DNA, 766 bp, Homo sapiens
tgattagcagccccaactaatgggtccaacctcagctccagacaccgctgcgctggtcgcccatccgccatcactgttgatgccagggtggttcttcccttcactgttgatgcccttggactctggtgaggcgcaggggaggggggaccgccactggcccctttccccggagtttctgggtggcacacagccccacagctcggcctctatctgtctgacccgtggtcctttgtgtgcacacagcactgggcagtgtggagggagcctggaggccactgccctcttccagtccccttgccagtctcggggtaccaggtgtctgggtgctggcagagccggcactgatgttttctggggtcaccagaaagccctggtttcaccacaaattgtgactgtcaggacacagtgctgctatggtcaggattcctttccatatgctgcttcagcctcagacctcggtgggccttaagagtaggggctgctcagccaggcgcagtggctcacgcctgtaatcccagcactttgggaggcagaggcgggtgggtcacctgaggtcgggagatcgagaccagcctgaccaatatggagaaaccctgtctctactaaatatacaaaattagccgggtgtggtggcatgtgcctgtaatcccagctacttaggaggctgaggcaggagaatcgcttgaacccaggaggcggaggttgcggtgagccaagatcgcaccattgcactccagcctgggcaacaagagcgaaactccgtctc

SEQ ID NO: 319691 - DNA, 142 bp, Homo sapiens
aattcaagcttctaacgatgtacggggacatgggtttttgttttactgctgtgcttgatgtacatgaagtattgtgtataaaaaaagagataagatttaaccaacatcaacaaaataaaaacccaaaatagtgctgtgttgg

SEQ ID NO: 319692 - DNA, 4263 bp, Homo sapiens
  misc_feature (2999)..(2999): n is a, c, g, or t
  misc_feature (3063)..(3063): n is a, c, g, or t
  misc_feature (3149)..(3149): n is a, c, g, or t
ggcgctgggcgggcggctgtgagcggcgctcggggcgcgctaggcggggagccgagccgggctggcggcaggcggacggggcgggcgcgtgcggcgcgagccgggcgctgaggacaagggccgctggtagggccggccggccggcgggcggagcgccgccgccgacgcacacgaggtgaccaggcattgatgcacccccaggaaggccacgcgctcaggaggcccccccgccccgctggctgctgctcacatggtgtctgggcccttggcactccgttcatgcgggagatggcaggggctggcacatgacagtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcagggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagtttcctactcaaggagagaagcggctgcgtgaagacataagcatcatgattaaattttggaccgccatgttctcagataagaagtacctgaccgccagccagcttgttcccccagctgacatcggcgacctcctggagcagttagtagaggagaacacaggctccttgtcgggcccagcgaaggacttttaccagcgggagtttgatttctttaacaagatcaccaacgtgtcggctatcatcaagccctaccctaaaggcgacgagagaaagaaggcttgtctgtcggccctgtctgaagtgacggtgcagccaggctgctccctgcccagcaaccccgaagccattgtgctggacgtcgactacaagtctgggaccccgatgcagagtgctgcaaaagccccatatctggccaagttcaaggtgaagcgatgtggagttagtgaacttgaaaaagaaggtctgcggtgccgctcagactctgaggatgagtgcagcacgcaggaggccgacggccagaagatctcctggcaggcagccatcttcaaactgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggtagccagggtggccacaggccggggaaagtcgtgtgtgctccaccctaccccagccacccatacccagcctctacccacaccctgctctcctcagtcatcctttgttaagggttaaaaccagggcacctgggctgggcacggtggctcacgcctgtaatcctagcactttgggaggccgaggcgggcagatcacgaggtcaagagatcaaaaccatcctggccaaaatggtgaaccctgtctctactaaaaatacaaaaattagctgggcatagtggcacgcgcctgcagtcccagctactcaggaagctgaggcaggagaatcgcttgaacccaggaggcagaggttgctgtgagccgagattgcatgccactgcactccagcctggcgacagagcgagactccatttaaaaaaaaaaacaccagggcatctgtaagccactttgggagtcaaaagaatgtagagctgggctggactccttagaagaaagttaagttctgagtgtgggaggaagtgcctgcacccccacatccagacagcccgtcactcctgctgccgaagactgacttgctgattcgggctctgcctccatagtgggggcacagagccagggagagtgcccacaggcccagggatcctgggtgtgggaccagggagaatgcccacaggccccagggcctttttgagcccagggcgctctctgcacaggcccgctacaacttcatccgaagcatggccgcctacagcctcctgctgttcctgctgcagatcaaggacagacacaacggcaacattatgctggacaagaagggccatatcatccacatcggtcagccagccacagcgccaccctcctctcccttcaccccggcacccaggggtggatagggatccccaccccacagagaggagaatgcccaggaccaccctgccaggagtgtcagggtccagctctgaggtccgaactgtcggccaccaagctgttctgctgtagagggtgcctggccccggccccagggagctggggcgagagccgccattgctctgagtcagaagctggagctgggcggagtggggctcgtccaggttcagtgccccagcttggctccttcctccacttcctcccttctctttctctgcctgctgccccaccacccaccccatcactgtctccaagaaaacacaacctgccttttgggggtggagggggtgctcctgttgcagagtccttttccactcctcaaaacagaccactcgtccttgcccgccctggctcctacccagtcacaggcagctctttggggttttgcagactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggtgagcctgggtgaggnccagggtggaggcggagggggtgtgtggaacgttctgagatcccctttaggatgaagggaatcnggttccagagagtgaggtaggtgctagcagccacctgctgacctacacctgtcctttggtcacctctgtctgcccacctgtgccantaaattcttgctctgggcatctaattccaaccaccttccccacaatcctgcccacgccttcagccatgggctctccctttctgggcatcccatccaccctgtcaccaaagcctgagcacctgccaccccacaggctacgtgccaaagatgggctttgtcccagtttcatatacaggtcacttggccaaggccacagtccaacctgggttcatccccactgccccgcagagaaaggcaggtcagcgtgtctgcatcccacccaggtgcagaagccatggccggcagccttatgtgggggacagggcaggacactcagcctgtccagagtgcgtatgggcagcccttgcctgggcagtacgggtgaccgagtgcagcagatcgaaagttgcctcggggatgtgcaagatgtggcaggcgaggtgggtggcaggagcccacacctgaggctgttggcatcagccagtccacaggactacaggcagggccaccacctaggctggcctcagcccaccgctccctcctgtctctccccaggccctacatggatgtggtcgtctccctggtcactatcatgttggacacgggcctgccctgttttcgcggccagacaatcaagttcttgaagcacaggtttagccccaacatgactgagcgcgaggctgcaaatttcatcatgaaggtcatccagagctgcttcctcagcaacaggagccggacctacaacatgatccagtactatcagaatgacatcccctactgaggaggggaccttcgagggcctctgccccatgtgcccttgaagctgccccacaatcatggagccctgcgacctacccgccctgccgccacatgcagtggaggagaggcctgtggcccgaagagcctggtagcgcctcctggggcagcacgtgggtggcgcaggcttagtaacgccgtggactgcagcgacaatcagtggatggtgctgtctatgcacaggtgtgagtcctctgtttgcactggacatattccctacctgttttatttcataggtacatgaagtattgtgtataaaaaaagagataagatttaaccaacatcaacaaaataaaaacccaaaatagtgctgtgttgg

SEQ ID NO: 319693 - DNA, 3560 bp, Homo sapiens
ggcgctgggcgggcggctgtgagcggcgctcggggcgcgctaggcggggagccgagccgggctggcggcaggcggacggggcgggcgcgtgcggcgcgagccgggcgctgaggacaagggccgctggtagggccggccggccggcgggcggagcgccgccgccgacgcacacgaggtgaccaggcattgatgcacccccaggaaggccacgcgctcaggaggcccccccgccccgctggctgctgctcacatggtgtctgggcccttggcactccgttcatgcgggagatggcaggggctggcacatgacagtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcagggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagtttcctactcaaggagagaagcggctgcgtgaagacataagcatcatgattaaattttggaccgccatgttctcagataagaagtacctgaccgccagccagcttgttcccccagctgacatcggcgacctcctggagcagttagtagaggagaacacaggctccttgtcgggcccagcgaaggacttttaccagcgggagtttgatttctttaacaagatcaccaacgtgtcggctatcatcaagccctaccctaaaggcgacgagagaaagaaggcttgtctgtcggccctgtctgaagtgacggtgcagccaggctgctccctgcccagcaaccccgaagccattgtgctggacgtcgactacaagtctgggaccccgatgcagagtgctgcaaaagccccatatctggccaagttcaaggtgaagcgatgtggagttagtgaacttgaaaaagaaggtctgcggtgccgctcagactctgaggatgagtgcagcacgcaggaggccgacggccagaagatctcctggcaggcagccatcttcaaactgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggtagccagggtggccacaggccggggaaagtcgtgtgtgctccaccctaccccagccacccatacccagcctctacccacaccctgctctcctcagtcatcctttgttaagggttaaaaccagggcacctgggctgggcacggtggctcacgcctgtaatcctagcactttgggaggccgaggcgggcagatcacgaggtcaagagatcaaaaccatcctggccaaaatggtgaaccctgtctctactaaaaatacaaaaattagctgggcatagtggcacgcgcctgcagtcccagctactcaggaagctgaggcaggagaatcgcttgaacccaggaggcagaggttgcagtgagccaagatcgtgccactgcactccagcctggcgacagagcgagactccatttaaaaaaaaaaacaccagggcatctgtaagccactttgggagtcaaaagaatgtagagctgggctggactccttagaagaaagttaagttctgagtgtgggaggaagtgcctgcacccccacatccagacagcccgtcactcctgctgccgaagactgacttgctgattcgggctctgcctccatagtgggggcacagagccagggagagtgcccacaggcccagggatcctgggtgtgggaccagggagaatgcccacaggccccagggcctttttgagcccagggcgctctctgcacaggcccgctacaacttcatccgaagcatggccgcctacagcctcctgctgttcctgctgcagatcaaggacagacacaacggcaacattatgctggacaagaagggccatatcatccacatcggtcagccagccacagcgccaccctcctctcccttcaccccggcacccaggggtggatagggatccccaccccacagagaggagaatgcccaggaccaccctgccaggagtgtcagggtccagctctgaggtccgaactgtcggccaccaagctgttctgctgtagagggtgcctggccccggccccagggagctggggcgagagccgccattgctctgagtcagaagctggagctgggcggagtggggctcgtccaggttcagtgccccagcttggctccttcctccacttcctcccttctctttctctgcctgctgccccaccacccaccccatcactgtctccaagaaaacacaacctgccttttgggggtggagggggtgctcctgttgcagagtccttttccactcctcaaaacagaccactcgtccttgcccgccctggctcctacccagtcacaggcagctctttggggttttgcagactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggatgtggtcgtctccctggtcactatcatgttggacacgggcctgccctgttttcgcggccagacaatcaagttcttgaagcacaggtttagccccaacatgactgagcgcgaggctgcaaatttcatcatgaaggtcatccagagctgcttcctcagcaacaggagccggacctacaacatgatccagtactatcagaatgacatcccctactgaggaggggaccttcgagggcctctgccccatgtgcccttgaagctgccccacaatcatggagccctgcgacctacccgccctgccgccacatgcagtggaggagaggcctgtggcccgaagagcctggtagcgcctcctggggcagcacgtgggtggcgcaggcttagtaacgccgtggactgcagcgacaatcagtggatggtgctgtctatgcacaggtgtgagtcctctgtttgcactggacatattccctacctgttttatttcataggtacatgaagtattgtgtataaaaaaagagataagatttaaccaacatcaacaaaataaaaacccaaaatagtgctgtgttgg

SEQ ID NO: 319694 - DNA, 2907 bp, Homo sapiens
  misc_feature (1643)..(1643): n is a, c, g, or t
  misc_feature (1707)..(1707): n is a, c, g, or t
  misc_feature (1793)..(1793): n is a, c, g, or t
gcctcagaactggcctttcctcctagtgcggggtgatcgagtgcatccccgactgcacctcccgggaccagctgggccgccagacagacttcggcatgtacgactacttcacacgccagtacggggatgagtccactctggccttccagcaggtagccagggtggccacaggccggggaaagtcgtgtgtgctccaccctaccccagccacccatacccagcctctacccacaccctgctctcctcagtcatcctttgttaagggttaaaaccagggcacctgggctgggcacggtggctcacgcctgtaatcctagcactttgggaggccgaggcgggcagatcacgaggtcaagagatcaaaaccatcctggccaaaatggtgaaccctgtctctactaaaaatacaaaaattagctgggcatagtggcacgcgcctgcagtcccagctactcaggaagctgaggcaggagaatcgcttgaacccaggaggcagaggttgctgtgagccgagattgcatgccactgcactccagcctggcgacagagcgagactccatttaaaaaaaaaaacaccagggcatctgtaagccactttgggagtcaaaagaatgtagagctgggctggactccttagaagaaagttaagttctgagtgtgggaggaagtgcctgcacccccacatccagacagcccgtcactcctgctgccgaagactgacttgctgattcgggctctgcctccatagtgggggcacagagccagggagagtgcccacaggcccagggatcctgggtgtgggaccagggagaatgcccacaggccccagggcctttttgagcccagggcgctctctgcacaggcccgctacaacttcatccgaagcatggccgcctacagcctcctgctgttcctgctgcagatcaaggacagacacaacggcaacattatgctggacaagaagggccatatcatccacatcggtcagccagccacagcgccaccctcctctcccttcaccccggcacccaggggtggatagggatccccaccccacagagaggagaatgcccaggaccaccctgccaggagtgtcagggtccagctctgaggtccgaactgtcggccaccaagctgttctgctgtagagggtgcctggccccggccccagggagctggggcgagagccgccattgctctgagtcagaagctggagctgggcggagtggggctcgtccaggttcagtgccccagcttggctccttcctccacttcctcccttctctttctctgcctgctgccccaccacccaccccatcactgtctccaagaaaacacaacctgccttttgggggtggagggggtgctcctgttgcagagtccttttccactcctcaaaacagaccactcgtccttgcccgccctggctcctacccagtcacaggcagctctttggggttttgcagactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggtgagcctgggtgaggnccagggtggaggcggagggggtgtgtggaacgttctgagatcccctttaggatgaagggaatcnggttccagagagtgaggtaggtgctagcagccacctgctgacctacacctgtcctttggtcacctctgtctgcccacctgtgccantaaattcttgctctgggcatctaattccaaccaccttccccacaatcctgcccacgccttcagccatgggctctccctttctgggcatcccatccaccctgtcaccaaagcctgagcacctgccaccccacaggctacgtgccaaagatgggctttgtcccagtttcatatacaggtcacttggccaaggccacagtccaacctgggttcatccccactgccccgcagagaaaggcaggtcagcgtgtctgcatcccacccaggtgcagaagccatggccggcagccttatgtgggggacagggcaggacactcagcctgtccagagtgcgtatgggcagcccttgcctgggcagtacgggtgaccgagtgcagcagatcgaaagttgcctcggggatgtgcaagatgtggcaggcgaggtgggtggcaggagcccacacctgaggctgttggcatcagccagtccacaggactacaggcagggccaccacctaggctggcctcagcccaccgctccctcctgtctctccccaggccctacatggatgtggtcgtctccctggtcactatcatgttggacacgggcctgccctgttttcgcggccagacaatcaagttcttgaagcacaggtttagccccaacatgactgagcgcgaggctgcaaatttcatcatgaaggtcatccagagctgcttcctcagcaacaggagccggacctacaacatgatccagtactatcagaatgacatcccctactgaggaggggaccttcgagggcctctgccccatgtgcccttgaagctgccccacaatcatggagccctgcgacctacccgccctgccgccacatgcagtggaggagaggcctgtggcccgaagagcctggtagcgcctcctggggcagcacgtgggtggcgcaggcttagtaacgccgtggactgcagcgacaatcagtggatggtgctgtctatgcacaggtgtgagtcctctgtttgcactggacatattccctacctgttttatttcataggtacatgaagtattgtgtataaaaaaagagataagatttaaccaacatcaacaaaataaaaacccaaaatagtgctgtgttgg

SEQ ID NO: 319695 - DNA, 2852 bp, Homo sapiens
ggcgctgggcgggcggctgtgagcggcgctcggggcgcgctaggcggggagccgagccgggctggcggcaggcggacggggcgggcgcgtgcggcgcgagccgggcgctgaggacaagggccgctggtagggccggccggccggcgggcggagcgccgccgccgacgcacacgaggtgaccaggcattgatgcacccccaggaaggccacgcgctcaggaggcccccccgccccgctggctgctgctcacatggtgtctgggcccttggcactccgttcatgcgggagatggcaggggctggcacatgacagtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcagggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagtttcctactcaaggagagaagcggctgcgtgaagacataagcatcatgattaaattttggaccgccatgttctcagataagaagtacctgaccgccagccagcttgttcccccagctgacatcggcgacctcctggagcagttagtagaggagaacacaggctccttgtcgggcccagcgaaggacttttaccagcgggagtttgatttctttaacaagatcaccaacgtgtcggctatcatcaagccctaccctaaaggcgacgagagaaagaaggcttgtctgtcggccctgtctgaagtgacggtgcagccaggctgctccctgcccagcaaccccgaagccattgtgctggacgtcgactacaagtctgggaccccgatgcagagtgctgcaaaagccccatatctggccaagttcaaggtgaagcgatgtggagttagtgaacttgaaaaagaaggtctgcggtgccgctcagactctgaggatgagtgcagcacgcaggaggccgacggccagaagatctcctggcaggcagccatcttcaaactgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggccatatcatccacatcggtcagccagccacagcgccaccctcctctcccttcaccccggcacccaggggtggatagggatccccaccccacagagaggagaatgcccaggaccaccctgccaggagtgtcagggtccagctctgaggtccgaactgtcggccaccaagctgttctgctgtagagggtgcctggccccggccccagggagctggggcgagagccgccattgctctgagtcagaagctggagctgggcggagtggggctcgtccaggttcagtgccccagcttggctccttcctccacttcctcccttctctttctctgcctgctgccccaccacccaccccatcactgtctccaagaaaacacaacctgccttttgggggtggagggggtgctcctgttgcagagtccttttccactcctcaaaacagaccactcgtccttgcccgccctggctcctacccagtcacaggcagctctttggggttttgcagactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggatgtggtcgtctccctggtcactatcatgttggacacgggcctgccctgttttcgcggccagacaatcaagttcttgaagcacaggtttagccccaacatgactgagcgcgaggctgcaaatttcatcatgaaggtcatccagagctgcttcctcagcaacaggagccggacctacaacatgatccagtactatcagaatgacatcccctactgaggaggggaccttcgagggcctctgccccatgtgcccttgaagctgccccacaatcatggagccctgcgacctacccgccctgccgccacatgcagtggaggagaggcctgtggcccgaagagcctggtagcgcctcctggggcagcacgtgggtggcgcaggcttagtaacgccgtggactgcagcgacaatcagtggatggtgctgtctatgcacaggtgtgagtcctctgtttgcactggacatattccctacctgttttatttcataggtacatgaagtattgtgtataaaaaaagagataagatttaaccaacatcaacaaaataaaaacccaaaatagtgctgtgttgg

SEQ ID NO: 319696 - DNA, 2248 bp, Homo sapiens
ggcgctgggcgggcggctgtgagcggcgctcggggcgcgctaggcggggagccgagccgggctggcggcaggcggacggggcgggcgcgtgcggcgcgagccgggcgctgaggacaagggccgctggtagggccggccggccggcgggcggagcgccgccgccgacgcacacgaggtgaccaggcattgatgcacccccaggaaggccacgcgctcaggaggcccccccgccccgctggctgctgctcacatggtgtctgggcccttggcactccgttcatgcgggagatggcaggggctggcacatgacagtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcagggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagtttcctactcaaggagagaagcggctgcgtgaagacataagcatcatgattaaattttggaccgccatgttctcagataagaagtacctgaccgccagccagcttgttcccccagctgacatcggcgacctcctggagcagttagtagaggagaacacaggctccttgtcgggcccagcgaaggacttttaccagcgggagtttgatttctttaacaagatcaccaacgtgtcggctatcatcaagccctaccctaaaggcgacgagagaaagaaggcttgtctgtcggccctgtctgaagtgacggtgcagccaggctgctccctgcccagcaaccccgaagccattgtgctggacgtcgactacaagtctgggaccccgatgcagagtgctgcaaaagccccatatctggccaagttcaaggtgaagcgatgtggagttagtgaacttgaaaaagaaggtctgcggtgccgctcagactctgaggatgagtgcagcacgcaggaggccgacggccagaagatctcctggcaggcagccatcttcaaactgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcagactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggatgtggtcgtctccctggtcactatcatgttggacacgggcctgccctgttttcgcggccagacaatcaagttcttgaagcacaggtttagccccaacatgactgagcgcgaggctgcaaatttcatcatgaaggtcatccagagctgcttcctcagcaacaggagccggacctacaacatgatccagtactatcagaatgacatcccctactgaggaggggaccttcgagggcctctgccccatgtgcccttgaagctgccccacaatcatggagccctgcgacctacccgccctgccgccacatgcagtggaggagaggcctgtggcccgaagagcctggtagcgcctcctggggcagcacgtgggtggcgcaggcttagtaacgccgtggactgcagcgacaatcagtggatggtgctgtctatgcacaggtgtgagtcctctgtttgcactggacatattccctacctgttttatttcataggtacatgaagtattgtgtataaaaaaagagataagatttaaccaacatcaacaaaataaaaacccaaaatagtgctgtgttgg

SEQ ID NO: 319697 - DNA, 1987 bp, Homo sapiens
ggcgctgggcgggcggctgtgagcggcgctcggggcgcgctaggcggggagccgagccgggctggcggcaggcggacggggcgggcgcgtgcggcgcgagccgggcgctgaggacaagggccgctggtagggccggccggccggcgggcggagcgccgccgccgacgcacacgaggtgaccaggcattgatgcacccccaggaaggccacgcgctcaggaggcccccccgccccgctggctgctgctcacatggtgtctgggcccttggcactccgttcatgcgggagatggcaggggctggcacatgacagtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcagggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagtttcctactcaaggagagaagcggctgcgtgaagacataagcatcatgattaaattttggaccgccatgttctcagataagaagtacctgaccgccagccagcttgttcccccagctgacatcggcgacctcctggagcagttagtagaggagaacacaggctccttgtcgggcccagcgaaggacttttaccagcgggagtttgatttctttaacaagatcaccaacgtgtcggctatcatcaagccctaccctaaaggcgacgagagaaagaaggcttgtctgtcggccctgtctgaagtgacggtgcagccaggctgctccctgcccagcaaccccgaagccattgtgctggacgtcgactacaagtctgggaccccgatgcagagtgctgcaaaagccccatatctggccaagttcaaggtgaagcgatgtggagttagtgaacttgaaaaagaaggtctgcggtgccgctcagactctgaggatgagtgcagcacgcaggaggccgacggccagaagatctcctggcaggcagccatcttcaaactgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggtagccagggtggccacaggccggggaaagtcgtgtgtgctccaccctaccccagccacccatacccagcctctacccacaccctgctctcctcagtcatcctttgttaagggttaaaaccagggcacctgggctgggcacggtggctcacgcctgtaatcctagcactttgggaggccgaggcgggcagatcacgaggtcaagagatcaaaaccatcctggccaaaatggtgaaccctgtctctactaaaaatacaaaaattagctgggcatagtggcacgcgcctgcagtcccagctactcaggaagctgaggcaggagaatcgcttgaacccaggaggcagaggttgctgtgagccgagattgcaccactgcactccagcctgggcaacagagtgagactccatctgaaaaaaaaaaaaaaccctattcatatcacctgtcgtccgccttggcccagtcgattctagacttggcgc

SEQ ID NO: 319698 - DNA, 472 bp, Homo sapiens
agggcagggaagagagtccataaggtgaacttggccccaggccaggctcctgctctgaccgggtccggggctccctcacaggctgctgaccctggggctgtccctcctgcatgccgatgtggttccaaatgcaaccatccgcaatgtgcttcgcgagaagatctactccactgcctttgactacttcaggtactcccccaagatgtgctgtgcagcatccagggacggcccagcccctccaagtgctccatcgccccagacccccaggaagtcactcacaggaatacacagttgcccagttgtgctcaccaacctcctccttcagtatccctggccctgtggatttaaatacctttcagccctgtgcatgtgtcccgtgtacttagagctagcctcccagcgagatgtaggcaaattttccctcagttcaactgatttaggagattaagtgcgtccatttaatttccctgtt

SEQ ID NO: 319699 - DNA, 319 bp, Homo sapiens
  misc_feature (313)..(313): n is a, c, g, or t
ccaggcgtggccttcacagcaccccatcttccaacatgtggaccccaaaggtacatttccagggcatggctctcagctgaagtccgtccccatggaagaccctcctcccactgggccagggagccagcacggccctgcccatggcagccctgacacagcctctcctccaggcacaggtttagccccaacatgactgagcgcgaggctgcaaatttcatcatgaaggtcatccagagctgcttcctcagcaacaggagccggaccgttctgattgctcaggctggagtgcaatggcgtgatctcggctcaccanaaactc

SEQ ID NO: 319700 - DNA, 4482 bp, Homo sapiens
  misc_feature (3218)..(3218): n is a, c, g, or t
  misc_feature (3282)..(3282): n is a, c, g, or t
  misc_feature (3368)..(3368): n is a, c, g, or t
cctcggctccatgggccttcctaatctggttagcgggatgaaggtatcgggtagggtctgtgtggggtggagaggaggagccaggccctggatccagaaccctcttctgcccttgccagctcagcagcccacagaggggtcttcccgctcacagccacagagggttatcagggttatagagaagagtcacctacccagtgcctgtcagggcatcaggtacatcccgggtgctgccacctcacacctgcaatgtccacacggtgaaccgggttgaacagaatgcagcctcgagaggctggagaaaatacaccaagcactgacacagatgaccctgggatgtgggactataggcgatcttcaattttttcttcatacttttcttggtttctaaatcttattcagtgagcacgtgttcctttttttaattagagaaaacttgacagtagcccctttttgtgtttcacagaggagctaacattccttctgtacctgtagttcatgcgggagatggcaggggctggcacatgacagtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcagggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagtttcctactcaaggagagaagcggctgcgtgaagacataagcatcatgattaaattttggaccgccatgttctcagataagaagtacctgaccgccagccagcttgttcccccagctgacatcggcgacctcctggagcagttagtagaggagaacacaggctccttgtcgggcccagcgaaggacttttaccagcgggagtttgatttctttaacaagatcaccaacgtgtcggctatcatcaagccctaccctaaaggcgacgagagaaagaaggcttgtctgtcggccctgtctgaagtgacggtgcagccaggctgctccctgcccagcaaccccgaagccattgtgctggacgtcgactacaagtctgggaccccgatgcagagtgctgcaaaagccccatatctggccaagttcaaggtgaagcgatgtggagttagtgaacttgaaaaagaaggtctgcggtgccgctcagactctgaggatgagtgcagcacgcaggaggccgacggccagaagatctcctggcaggcagccatcttcaaactgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggtagccagggtggccacaggccggggaaagtcgtgtgtgctccaccctaccccagccacccatacccagcctctacccacaccctgctctcctcagtcatcctttgttaagggttaaaaccagggcacctgggctgggcacggtggctcacgcctgtaatcctagcactttgggaggccgaggcgggcagatcacgaggtcaagagatcaaaaccatcctggccaaaatggtgaaccctgtctctactaaaaatacaaaaattagctgggcatagtggcacgcgcctgcagtcccagctactcaggaagctgaggcaggagaatcgcttgaacccaggaggcagaggttgctgtgagccgagattgcatgccactgcactccagcctggcgacagagcgagactccatttaaaaaaaaaaacaccagggcatctgtaagccactttgggagtcaaaagaatgtagagctgggctggactccttagaagaaagttaagttctgagtgtgggaggaagtgcctgcacccccacatccagacagcccgtcactcctgctgccgaagactgacttgctgattcgggctctgcctccatagtgggggcacagagccagggagagtgcccacaggcccagggatcctgggtgtgggaccagggagaatgcccacaggccccagggcctttttgagcccagggcgctctctgcacaggcccgctacaacttcatccgaagcatggccgcctacagcctcctgctgttcctgctgcagatcaaggacagacacaacggcaacattatgctggacaagaagggccatatcatccacatcggtcagccagccacagcgccaccctcctctcccttcaccccggcacccaggggtggatagggatccccaccccacagagaggagaatgcccaggaccaccctgccaggagtgtcagggtccagctctgaggtccgaactgtcggccaccaagctgttctgctgtagagggtgcctggccccggccccagggagctggggcgagagccgccattgctctgagtcagaagctggagctgggcggagtggggctcgtccaggttcagtgccccagcttggctccttcctccacttcctcccttctctttctctgcctgctgccccaccacccaccccatcactgtctccaagaaaacacaacctgccttttgggggtggagggggtgctcctgttgcagagtccttttccactcctcaaaacagaccactcgtccttgcccgccctggctcctacccagtcacaggcagctctttggggttttgcagactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggtgagcctgggtgaggnccagggtggaggcggagggggtgtgtggaacgttctgagatcccctttaggatgaagggaatcnggttccagagagtgaggtaggtgctagcagccacctgctgacctacacctgtcctttggtcacctctgtctgcccacctgtgccantaaattcttgctctgggcatctaattccaaccaccttccccacaatcctgcccacgccttcagccatgggctctccctttctgggcatcccatccaccctgtcaccaaagcctgagcacctgccaccccacaggctacgtgccaaagatgggctttgtcccagtttcatatacaggtcacttggccaaggccacagtccaacctgggttcatccccactgccccgcagagaaaggcaggtcagcgtgtctgcatcccacccaggtgcagaagccatggccggcagccttatgtgggggacagggcaggacactcagcctgtccagagtgcgtatgggcagcccttgcctgggcagtacgggtgaccgagtgcagcagatcgaaagttgcctcggggatgtgcaagatgtggcaggcgaggtgggtggcaggagcccacacctgaggctgttggcatcagccagtccacaggactacaggcagggccaccacctaggctggcctcagcccaccgctccctcctgtctctccccaggccctacatggatgtggtcgtctccctggtcactatcatgttggacacgggcctgccctgttttcgcggccagacaatcaagttcttgaagcacaggtttagccccaacatgactgagcgcgaggctgcaaatttcatcatgaaggtcatccagagctgcttcctcagcaacaggagccggacctacaacatgatccagtactatcagaatgacatcccctactgaggaggggaccttcgagggcctctgccccatgtgcccttgaagctgccccacaatcatggagccctgcgacctacccgccctgccgccacatgcagtggaggagaggcctgtggcccgaagagcctggtagcgcctcctggggcagcacgtgggtggcgcaggcttagtaacgccgtggactgcagcgacaatcagtggatggtgctgtctatgcacaggtgtgagtcctctgtttgcactggacatattccctacctgttttatttcataggtacatgaagtattgtgtataaaaaaagagataagatttaaccaacatcaacaaaataaaaacccaaaatagtgctgtgttgg

SEQ ID NO: 319701 - DNA, 3718 bp, Homo sapiens
  misc_feature (2454)..(2454): n is a, c, g, or t
  misc_feature (2518)..(2518): n is a, c, g, or t
  misc_feature (2604)..(2604): n is a, c, g, or t
gggccagatcatccttgctaatgactggctttgggctgaccttttgtcattaagaaattgtctgcatcaccttctcactgctttgtgtgactggcctctagtccctgactccagacactcagccgttgtcctcttatggttgtttgaagctgtcccccaaagtttcctactcaaggagagaagcggctgcgtgaagacataagcatcatgattaaattttggaccgccatgttctcagataagaagtacctgaccgccagccagcttgttcccccagctgacatcggcgacctcctggagcagttagtagaggagaacacaggctccttgtcgggcccagcgaaggacttttaccagcgggagtttgatttctttaacaagatcaccaacgtgtcggctatcatcaagccctaccctaaaggcgacgagagaaagaaggcttgtctgtcggccctgtctgaagtgacggtgcagccaggctgctccctgcccagcaaccccgaagccattgtgctggacgtcgactacaagtctgggaccccgatgcagagtgctgcaaaagccccatatctggccaagttcaaggtgaagcgatgtggagttagtgaacttgaaaaagaaggtctgcggtgccgctcagactctgaggatgagtgcagcacgcaggaggccgacggccagaagatctcctggcaggcagccatcttcaaactgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggtagccagggtggccacaggccggggaaagtcgtgtgtgctccaccctaccccagccacccatacccagcctctacccacaccctgctctcctcagtcatcctttgttaagggttaaaaccagggcacctgggctgggcacggtggctcacgcctgtaatcctagcactttgggaggccgaggcgggcagatcacgaggtcaagagatcaaaaccatcctggccaaaatggtgaaccctgtctctactaaaaatacaaaaattagctgggcatagtggcacgcgcctgcagtcccagctactcaggaagctgaggcaggagaatcgcttgaacccaggaggcagaggttgctgtgagccgagattgcatgccactgcactccagcctggcgacagagcgagactccatttaaaaaaaaaaacaccagggcatctgtaagccactttgggagtcaaaagaatgtagagctgggctggactccttagaagaaagttaagttctgagtgtgggaggaagtgcctgcacccccacatccagacagcccgtcactcctgctgccgaagactgacttgctgattcgggctctgcctccatagtgggggcacagagccagggagagtgcccacaggcccagggatcctgggtgtgggaccagggagaatgcccacaggccccagggcctttttgagcccagggcgctctctgcacaggcccgctacaacttcatccgaagcatggccgcctacagcctcctgctgttcctgctgcagatcaaggacagacacaacggcaacattatgctggacaagaagggccatatcatccacatcggtcagccagccacagcgccaccctcctctcccttcaccccggcacccaggggtggatagggatccccaccccacagagaggagaatgcccaggaccaccctgccaggagtgtcagggtccagctctgaggtccgaactgtcggccaccaagctgttctgctgtagagggtgcctggccccggccccagggagctggggcgagagccgccattgctctgagtcagaagctggagctgggcggagtggggctcgtccaggttcagtgccccagcttggctccttcctccacttcctcccttctctttctctgcctgctgccccaccacccaccccatcactgtctccaagaaaacacaacctgccttttgggggtggagggggtgctcctgttgcagagtccttttccactcctcaaaacagaccactcgtccttgcccgccctggctcctacccagtcacaggcagctctttggggttttgcagactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggtgagcctgggtgaggnccagggtggaggcggagggggtgtgtggaacgttctgagatcccctttaggatgaagggaatcnggttccagagagtgaggtaggtgctagcagccacctgctgacctacacctgtcctttggtcacctctgtctgcccacctgtgccantaaattcttgctctgggcatctaattccaaccaccttccccacaatcctgcccacgccttcagccatgggctctccctttctgggcatcccatccaccctgtcaccaaagcctgagcacctgccaccccacaggctacgtgccaaagatgggctttgtcccagtttcatatacaggtcacttggccaaggccacagtccaacctgggttcatccccactgccccgcagagaaaggcaggtcagcgtgtctgcatcccacccaggtgcagaagccatggccggcagccttatgtgggggacagggcaggacactcagcctgtccagagtgcgtatgggcagcccttgcctgggcagtacgggtgaccgagtgcagcagatcgaaagttgcctcggggatgtgcaagatgtggcaggcgaggtgggtggcaggagcccacacctgaggctgttggcatcagccagtccacaggactacaggcagggccaccacctaggctggcctcagcccaccgctccctcctgtctctccccaggccctacatggatgtggtcgtctccctggtcactatcatgttggacacgggcctgccctgttttcgcggccagacaatcaagttcttgaagcacaggtttagccccaacatgactgagcgcgaggctgcaaatttcatcatgaaggtcatccagagctgcttcctcagcaacaggagccggacctacaacatgatccagtactatcagaatgacatcccctactgaggaggggaccttcgagggcctctgccccatgtgcccttgaagctgccccacaatcatggagccctgcgacctacccgccctgccgccacatgcagtggaggagaggcctgtggcccgaagagcctggtagcgcctcctggggcagcacgtgggtggcgcaggcttagtaacgccgtggactgcagcgacaatcagtggatggtgctgtctatgcacaggtgtgagtcctctgtttgcactggacatattccctacctgttttatttcataggtacatgaagtattgtgtataaaaaaagagataagatttaaccaacatcaacaaaataaaaacccaaaatagtgctgtgttgg

SEQ ID NO: 319702 - DNA, 2369 bp, Homo sapiens
ggcgctgggcgggcggctgtgagcggcgctcggggcgcgctaggcggggagccgagccgggctggcggcaggcggacggggcgggcgcgtgcggcgcgagccgggcgctgaggacaagggccgctggtagggccggccggccggcgggcggagcgccgccgccgacgcacacgaggtgaccaggcattgatgcacccccaggaaggccacgcgctcaggaggcccccccgccccgctggctgctgctcacatggtgtctgggcccttggcactccgttcatgcgggagatggcaggggctggcacatgacagtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcagggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagtttcctactcaaggagagaagcggctgcgtgaagacataagcatcatgattaaattttggaccgccatgttctcagataagaagtacctgaccgccagccagcttgttcccccagctgacatcggcgacctcctggagcagttagtagaggagaacacaggctccttgtcgggcccagcgaaggacttttaccagcgggagtttgatttctttaacaagatcaccaacgtgtcggctatcatcaagccctaccctaaaggcgacgagagaaagaaggcttgtctgtcggccctgtctgaagtgacggtgcagccaggctgctccctgcccagcaaccccgaagccattgtgctggacgtcgactacaagtctgggaccccgatgcagagtgctgcaaaagccccatatctggccaagttcaaggtgaagcgatgtggagttagtgaacttgaaaaagaaggtctgcggtgccgctcagactctgaggatgagtgcagcacgcaggaggccgacggccagaagatctcctggcaggcagccatcttcaaactgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggccatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggatgtggtcgtctccctggtcactatcatgttggacacgggcctgccctgttttcgcggccagacaatcaagttcttgaagcacaggtttagccccaacatgactgagcgcgaggctgcaaatttcatcatgaaggtcatccagagctgcttcctcagcaacaggagccggacctacaacatgatccagtactatcagaatgacatcccctactgaggaggggaccttcgagggcctctgccccatgtgcccttgaagctgccccacaatcatggagccctgcgacctacccgccctgccgccacatgcagtggaggagaggcctgtggcccgaagagcctggtagcgcctcctggggcagcacgtgggtggcgcaggcttagtaacgccgtggactgcagcgacaatcagtggatggtgctgtctatgcacaggtgtgagtcctctgtttgcactggacatattccctacctgttttatttcataggtacatgaagtattgtgtataaaaaaagagataagatttaaccaacatcaacaaaataaaaacccaaaatagtgctgtgttgg

SEQ ID NO: 319703 - DNA, 2152 bp, Homo sapiens
  misc_feature (2152)..(2152): n is a, c, g, or t
ggcgctgggcgggcggctgtgagcggcgctcggggcgcgctaggcggggagccgagccgggctggcggcaggcggacggggcgggcgcgtgcggcgcgagccgggcgctgaggacaagggccgctggtagggccggccggccggcgggcggagcgccgccgccgacgcacacgaggtgaccaggcattgatgcacccccaggaaggccacgcgctcaggaggcccccccgccccgctggctgctgctcacatggtgtctgggcccttggcactccgttcatgcgggagatggcaggggctggcacatgacagtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcagggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagtttcctactcaaggagagaagcggctgcgtgaagacataagcatcatgattaaattttggaccgccatgttctcagataagaagtacctgaccgccagccagcttgttcccccagctgacatcggcgacctcctggagcagttagtagaggagaacacaggctccttgtcgggcccagcgaaggacttttaccagcgggagtttgatttctttaacaagatcaccaacgtgtcggctatcatcaagccctaccctaaaggcgacgagagaaagaaggcttgtctgtcggccctgtctgaagtgacggtgcagccaggctgctccctgcccagcaaccccgaagccattgtgctggacgtcgactacaagtctgggaccccgatgcagagtgctgcaaaagccccatatctggccaagttcaaggtgaagcgatgtggagttagtgaacttgaaaaagaaggtctgcggtgccgctcagactctgaggatgagtgcagcacgcaggaggccgacggccagaagatctcctggcaggcagccatcttcaaactgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggtagccagggtggccacaggccggggaaagtcgtgtgtgctccaccctaccccagccacccatacccagcctctacccacaccctgctctcctcagtcatcctttgttaagggttaaaaccagggcacctgggctgggcacggtggctcacgcctgtaatcctagcactttgggaggccgaggcgggcagatcacgaggtcaagagatcaaaaccatcctggccaaaatggtgaaccctgtctctactaaaaatacaaaaattagctgggcatagtggcacgcgcctgcagtcccagctactcaggaagctgaggcaggagaatcgcttgaacccaggaggcagaggttgctgtgagccgagattgcaccactgcactccagcctgggcaacagagtgagactccatctgaaaaaaaaaaaaaagggaggccaaggcgggcagatcatgaggtcaagagatcgagaccatcctgaccaacatggtgaaaccccatctctactaacaaatacctcccctccctatatcacatggcggcccgccttggcccaaccgactttagacttcgcgcaggtttatgcacgcgggcccgaattcggggctcaatcggccaatttcgccctgggggccggattacattctgcn

SEQ ID NO: 319704 - DNA, 1430 bp, Homo sapiens
ggcgctgggcgggcggctgtgagcggcgctcggggcgcgctaggcggggagccgagccgggctggcggcaggcggacggggcgggcgcgtgcggcgcgagccgggcgctgaggacaagggccgctggtagggccggccggccggcgggcggagcgccgccgccgacgcacacgaggtgaccaggcattgatgcacccccaggaaggccacgcgctcaggaggcccccccgccccgctggctgctgctcacatggtgtctgggcccttggcactccgttcatgcgggagatggcaggggctggcacatgacagtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcagggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagtttcctactcaaggagagaagcggctgcgtgaagacataagcatcatgattaaattttggaccgccatgttctcagataagaagtacctgaccgccagccagcttgttcccccagctgacatcggcgacctcctggagcagttagtagaggagaacacaggctccttgtcgggcccagcgaaggacttttaccagcgggagtttgatttctttaacaagatcaccaacgtgtcggctatcatcaagccctaccctaaaggcgacgagagaaagaaggcttgtctgtcggccctgtctgaagtgacggtgcagccaggctgctccctgcccagcaaccccgaagccattgtgctggacgtcgactacaagtctgggaccccgatgcagagtgctgcaaaagccccatatctggccaagttcaaggtgaagcgatgtggagttagtgaacttgaaaaagaaggtctgcggtgccgctcagactctgaggatgagtgcagcacgcaggaggccgacggccagaagatctcctggcaggcagccatcttcaaactgggagacgactgccggcaggtaagcagggtcaggcctcaagtaggcttggggactgggcttgctgctccccaaggctccaggcccaccagagtccaatctcatatgcagaaatgtgaatcttttccttctcttacatggttcaggtgccacggggtaaattagggcttctgc

SEQ ID NO: 319705 - DNA, 404 bp, Homo sapiens
gtgacatctcccctggacacccagctttaaaatttctctgttttgtactctgtccctttatttctcagaccagccaacatttagggaaaatagaaaagaacctatgtgaaatattgggggtgaattttgcccgatatctgactgaatttcccatgataaccactctccaagttttcctacctctctcatcacttcttatttgccttttcagttccccattcagttccagttcttctttctccatcatgctttaagtcctacattcctttctatgttctcatcctttggaggtggtctcatgtactcccacggcttcggataccatgtatttattgacaacagtgaaacttatgtctccagtgtacatgagtcctgaacctcaaaccccaatgatatctccaata

SEQ ID NO: 319706 - DNA, 428 bp, Homo sapiens
caggcacttcaaaatgcacataccctaaaccaaactccaaatcttcccctactcccaagcctgctccactccgacagttgctcaggccagatcaacggggctcatgctgactcctcttgctctcgccctacgtccagttggtcagcagaccctattggctctaccttcagtctgcatccagaacacccctgctcactttctccccttctctcataagccgctggaccagggtccctgcgtctgccctgcaccctggcattttctcctccactctacaggcagagggagcctttaacatgcaaatcaggtcttatgcccccggcttaaaaccctccagtggctccctccttgctctaaggaaaagggtcttcaggatggccttaggtcctgcttgacaatcaccccacccctactgtcaccactgacct

SEQ ID NO: 319707 - DNA, 3280 bp, Homo sapiens
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 319708 - DNA, 460 bp, Homo sapiens
  misc_feature (31)..(31): n is a, c, g, or t
aagcgatggcttcctctggtgctccaccacntacaactttgagaaggatggcaagtacggcttctgtccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacaaaccaagccgtggcttcccgctcagccctccctgcccctcccttcaaccattccccatgggaaatgtcaacaagtatgaataaagacacctactgagtggc

SEQ ID NO: 319709 - DNA, 2984 bp, Homo sapiens
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 319710 - DNA, 2685 bp, Homo sapiens
tgtaaacaacttttggacacatctgggcagttgctaagggctcttgccaagcgtctagcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 319711 - DNA, 2678 bp, Homo sapiens
cagcccgggcttggagtgcagtggggcaatgctcgggtcgctgcgacctccgcctcctgggttcaggtgattctctggcctcagtctcccgagtagctgggatttacaggcacccgccgccacgcctggctaatttttgtatttttagtagagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 319712 - DNA, 2233 bp, Homo sapiens
gggcagccatagaaggtgttcaggtattgcactgccaactctttgtccgttttgggggcgacatcgccggggaacttgatgatgggcgacggcgcggcggcgaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 319713 - DNA, 3734 bp, Homo sapiens
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggccgtgtttgccatctgttttagcagagcctagacaagggccacagacccagccagaagcggaaacttaaaaagtccgaatctctgctccctgcagggcacaggtgatggtgtctgctggaaaggtcagagcttccaaagtaaacagcaagagaacctcagggagagtaagctctagtccctctgtcctgtagaaagagccctgaagaatcagcaattttgttgctttattgtggcatctgttcgaggtttgcttcctctttaagtctgtttcttcattagcaatcatatcagttttaatgctactactaacaatgaacagtaacaataatatccccctcaattaatagagtgctttctatgtgcaaggcacttttcacgtgtcacctattttaacctttccaaccacataaataaaaaaggccattattagttgaatcttattgatgaagagact

SEQ ID NO: 319714 - DNA, 3285 bp, Homo sapiens
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaatactctagagctggctctagaggatgagccctctctgcttctcccctcacacgtaaataatgggttttgtcaatccgtatgtatatatacatattcttggttaaaa

SEQ ID NO: 319715 - DNA, 2862 bp, Homo sapiens
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctgttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 319716 - DNA, 3316 bp, Homo sapiens
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctgttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggccgtgtttgccatctgttttagcagagcctagacaagggccacagacccagccagaagcggaaacttaaaaagtccgaatctctgctccctgcagggcacaggtgatggtgtctgctggaaaggtcagagcttccaaagtaaacagcaagagaacctcagggagagtaagctctagtccctctgtcctgtagaaagagccctgaagaatcagcaattttgttgctttattgtggcatctgttcgaggtttgcttcctctttaagtctgtttcttcattagcaatcatatcagttttaatgctactactaacaatgaacagtaacaataatatccccctcaattaatagagtgctttctatgtgcaaggcacttttcacgtgtcacctattttaacctttccaaccacataaataaaaaaggccattattagttgaatcttattgatgaagagact

SEQ ID NO: 319717 - DNA, 2293 bp, Homo sapiens
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggaggtaagggagggcggtgggtaggac

SEQ ID NO: 319718 - DNA, 1634 bp, Homo sapiens
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagcggcccgccgcacctcgtgccggtccga

SEQ ID NO: 319719 - DNA, 1246 bp, Homo sapiens
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 319720 - DNA, 1097 bp, Homo sapiens
  misc_feature (22)..(22): n is a, c, g, or t
taagggctagtacgaggcctgnggttggctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 319721 - DNA, 950 bp, Homo sapiens
  misc_feature (823)..(823): n is a, c, g, or t
  misc_feature (826)..(826): n is a, c, g, or t
  misc_feature (843)..(844): n is a, c, g, or t
  misc_feature (874)..(874): n is a, c, g, or t
  misc_feature (876)..(876): n is a, c, g, or t
  misc_feature (884)..(884): n is a, c, g, or t
  misc_feature (887)..(887): n is a, c, g, or t
  misc_feature (910)..(910): n is a, c, g, or t
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagcgagggtgggggaaggcgagaagatntgnaagtagacaattgttgnntgtgaaagggcaatatttagaaaaaagcanangagaacancantatgattttgtacagcacgcgtnatcgctttaggcgcatcatagcaataattatatattgcgc

SEQ ID NO: 319722 - DNA, 738 bp, Homo sapiens
  misc_feature (679)..(679): n is a, c, g, or t
  misc_feature (683)..(683): n is a, c, g, or t
ttgtagagaccctggccagaatacaaagaaacagacctgctaatactttttcaaggacgattactttgccaaaaaaaatgaagaaagaaaacaaaataaagtggaagctaaattaagagctaaacaggagcaagaagcaaaacaaaagttagaagaagatgctatctggggctttaaacatacaaagggattggccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctggggaagcattgggcgaatggggaatacccccttttgnaacnggttaagggaaccgggaacttccctggggcttcattggcctttccgcccccaagg

SEQ ID NO: 319723 - DNA, 3200 bp, Homo sapiens
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaacaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 319724 - DNA, 2895 bp, Homo sapiens
ttgtagagaccctggccagaatacaaagaaacagacctgctaatactttttcaaggacgattactttgccaaaaaaaatgaagaaagaaaacaaaataaagtggaagctaaattaagagctaaacaggagcaagaagcaaaacaaaagttagaagaagatgctatctggggctttaaacatacaaagggattggccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 319725 - DNA, 2284 bp, Homo sapiens
  misc_feature (22)..(22): n is a, c, g, or t
taagggctagtacgaggcctgnggttggctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 319726 - DNA, 2755 bp, Homo sapiens
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 319727 - DNA, 3492 bp, Homo sapiens
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggcaacaaaacaaacacacaaaaaaacaaacaaaaaaaaaaaaacaaaacacacacacaaaacggaacgaggaagaaagaagagaagaaaggaagagcgcagagaccggcagagcaccgagaggagaccgcgggagcgagaagagaccgcgagagagagtgaagagaggacgaaaggaagcgagatgaaggaaggagacagggggagaggcccgt

SEQ ID NO: 319728 - DNA, 1241 bp, Homo sapiens
agggtcgtgccaattacatttcatttgcatggattttggttttcatgctctgtcctcccctcctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 319729 - DNA, 3139 bp, Homo sapiens
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacaaccaagccgtggcttcccgctcagccctccctgcccctcccttcaaccattccccatgggaaatgtcaacaagtatgaataaagacacctactgagtggc

SEQ ID NO: 319730 - DNA, 2742 bp, Homo sapiens
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacactgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaactagagaaggacccggaggggcctggcagccgtgccttcagctctacagctaatcagcattctcactcctacctgttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 319731 - DNA, 2093 bp, Homo sapiens
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaagggtacagcctgttcctcgtggcagcccacgagtttggccacgccatggggctggagcactcccaagaccccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggc

SEQ ID NO: 319732 - DNA, 1419 bp, Homo sapiens
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatggcaacgccgatggggagtactgcaagttccccttcttgttcaatggcaaggagtacaacagctgcactgataccggccgcagcgatggcttgcgtctttcaactgcggttgaagccagctcctctttctttctttctcttggctcattacattcctcattttccatctgggtggtatgagtcttgtcagattcttccagcatcaggtcttttttacctctgacaaccgcagttgaaagacgca

SEQ ID NO: 319733 - DNA, 1018 bp, Homo sapiens
gaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacaaaccaagccgtggcttcccgctcagccctccctgcccctcccttcaaccattccccatgggaaatgtcaacaagtatgaataaagacacctactgagtggc

SEQ ID NO: 319734 - DNA, 947 bp, Homo sapiens
  misc_feature (878)..(878): n is a, c, g, or t
  misc_feature (880)..(880): n is a, c, g, or t
  misc_feature (901)..(901): n is a, c, g, or t
  misc_feature (923)..(923): n is a, c, g, or t
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccccccgggcttgacttgtngnagggaccttcaggaagcctanaaccacttccaagggaggattnaggaaaacccgttttcgccaaggg

SEQ ID NO: 319735 - DNA, 1437 bp, Homo sapiens
tggaagttctgaaagggtgtaaggaaagaagtagggaaagcctcttggctgccagacgtaatagaggtccctctctgagttgacaccactgcaggaaaatgttatctctggattcccctgagttaaggtcggcagaggctgctggagaaatttatctgtcaaaggattttcctgaggtagttgcagcttccaaaatgcctccaaagacaggtggcacccgtttttttaaattatttaattatatatatatattatatatatatacacacacacacacacacacacacacacatatatgagtgtatctgtctatctttttaaaagcatgacctacagacttaaaacagccaaccaggaaacactattccacttttttttttcttttctcatttctcattgctaataaatgtcccaaaggtgggacttctctgacctcaccgctgactaaggctcttttccttccagactttgggtcacttggaaaaagcagtggttcttgaacttaccttgaagcatgtgaaagcactaacaaacctaattgatcagcagcagcagaaaatcattgccctgcagagtggtttacaagctggtgagtgctgattctggctatgctctctttaagagtttgagtgcaaatagagagcccgtgggctcaacatctgatgtaataaacattactgcaacaaattgcttatgcacgttcattgggggagatgcagttttatctttcctaaaaggtcagacttttcatttgaaatgcattgtgccacctggcatgaatacgtattagtgaaatgataagatattcctgtggcattttagcttgagagtctctgggttctgggagatttccctactcccttttaaaatgccaaggcacctataatttgcattgtgggtgttttacagttggtcttcttagccctctttcattggagaagaaatcatgggtatgccccagcgttttcctgtttctttgcttccttgtcacttggtgtgtggtgtgatcctggcaggatacagcaggagtttttcctgcatttcatgtggttccctgaatagccactaggtatcttggtgaattgcacaatctagcgaaaccactgaagtttcatcattcgtttctactgacttccagataatcggagtcaaccttctaaccttctagtctcacttcttccaaataatactgtacagactggggagaattattctacccactccctcatttcatgcttgtctgccttcctctcgaaggctcgtatgatgaaaattgcaaaaacccagctagtgcttctgcctgtttcctcattcaaaataggaagatggtcatacctaatgtcttgaggatcatggatagaatatgtggagaagacatagaaatagcctaattaaaggtcacagcatgactgcaacttttacaaatcattgaaaata

SEQ ID NO: 319736 - DNA, 205 bp, Homo sapiens
ggctttatcgtatcatattttgtttttatagcagaccgggtcaaagtttgtgtttaacccttcccctctaccactccccccaccttttttgttgttgttgtcaaataaggggacttgctttggtgtgtgatttttacggcctgtcctttcttgacagtagccctcggctacttcgcagcctttggttggggaaatggaaaaaaaa

SEQ ID NO: 319737 - DNA, 3512 bp, Homo sapiens
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaaaaaaaaaaaaaaaaaaaaaaaaaaaaaaaaaaaaaaaacaaaaaagaaaaaaaaaaaaaaaaaaaaaaaaagaaaaaaaaaaaaagaaaaaaaaacagaaaagaaagcctccaaggatcaacgcaacactacaccaagaccacaagaaaggcgaaacaacagcgaaagccggaccacatacaggcccgacccgcccgagcggaccagtcacagcaacagccaacaggcgaactggcggagggagcgacagaacgcccgcaagaacaagagaaatagaacaagacgccacacacagacacggcaaatagagatcagaaaccgcggcggaaccagaacaaacgagcgggacacagacggcaagaaggcccgaacacaaagccagcaaaccaacaaggaggagacaggaagagacaaacaacagagaaccagagcaaacaaccgcagcaaaccgc

SEQ ID NO: 319738 - DNA, 2715 bp, Homo sapiens
  misc_feature (21)..(21): n is a, c, g, or t
  misc_feature (32)..(32): n is a, c, g, or t
ttcccagtggtctttggtacnccacgcagtantggatatcgtcgaccacgcctcgcggagacctagcaggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaa

SEQ ID NO: 319739 - DNA, 3329 bp, Homo sapiens
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggtaagcaagtgcacccctagggaccctgcgctcagcccctcgcgcgcgctgagtttccaagaaaagttttctcgctttgaggttggcgaggggatgcagggtgtgggctcggtgcctcttctgagtgacttggaaaagaaagggcagacgatggttctgggtgctactctgctactctgctcctctgccggactgttgctgcggggctgggaggataggcttctcatctccttccccaagcgcccaccgcctccccgtgcgtcttgcaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaa

SEQ ID NO: 319740 - DNA, 3003 bp, Homo sapiens
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagagaggtacagtgtttatattttggagccttcctgaaggtgtaaaattgtaaatatttttatctatgagtaaatgttaagtagttgttttaaaatacttaataaaataattcttttcctgtggaa

SEQ ID NO: 319741 - DNA, 2440 bp, Homo sapiens
ttaacaaaaactaaagcacctggttttttggagtatagtttccaggtgcgccacaggccttctgaaacgttttccttcggatttttctttccccaggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaa

SEQ ID NO: 319742 - DNA, 2710 bp, Homo sapiens
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagaaccacaaatatcggggtacgagctc

SEQ ID NO: 319743 - DNA, 1652 bp, Homo sapiens
ctagctaccttgaatccggatgcagtggccggcaagccagagccttatatgcctgttacagttgttcactcagttccttcaggactgccctgtccactcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaa

SEQ ID NO: 319744 - DNA, 1408 bp, Homo sapiens
tgtttccctttgtctgttttaagtctgtaggtcatgcttttaaaaagatagacagatacactcatagtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaa

SEQ ID NO: 319745 - DNA, 1447 bp, Homo sapiens
acagtttaacttttccctctgtgcgggtttgcttttcacccttccctgccactggggttgagcccaagaacacttccttgtgagagagagagagagagagcacgagtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaa

SEQ ID NO: 319746 - DNA, 1559 bp, Homo sapiens
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgatactctcttcttgtacatctcgtctcttctaagctaggtgccgagctcgatcc

SEQ ID NO: 319747 - DNA, 2112 bp, Homo sapiens
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacacacacacacgaacagacacagacacacgtcactcactctctctctctctcctctcccaccgcggatgtcaacgtggaaaataagagagacacacacacacacacaagactgatgatgacagcagacgtggcgacgaccaaggagctcggcgcccacgtccgcgcacacgagaagaaccacgacgactcaggggcgcgcgaggacaggccaacaactccgaacagcgcggcaacaacgagcaacgcaccacgcactactgaccaacagcaaacgcagcacacgcaaccacgcggcggcctcatacaaaacctcacagcagactgagaaacacacacagccacccaccagccacccgctcctcaccaacggaacgcgcaacgggggacaacactcactaagactaacagacatactacaccacacccacacaacacacaaacaaaacgatggcgaatgcggacaagcacaccgagcgcagccaactcccacaccacagcagggcacccccaacagcagcagacaaaacgagacaacccgacacgcacaatacgaggagacaacacaaaaagcgagcagcacgcacccaccactacacacgtacacccacaaaccaaaccacaccaacacacaaacgagatagaacggaaacacggaggacatgccacacacactgtaccccacgcacgcggggcggccaacacgagcgcaaaaacacacacacgacgaacaatccgacgaccacacagaaggccagccagcaaacaaccacaggtcgcgaggcgcgacaaccaataaagcgggggcagacaacactggatccacacacag

SEQ ID NO: 319748 - DNA, 1564 bp, Homo sapiens
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagtgctgattctggctatgctctctttaagagtttgagtgcaaatagagagcccgtgggctcaacatctgatgtaataaacattactgcaacaaattgcttatgcacgttcattgggggagatgcagttttatctttcctaaaaggtcagacttttcatttgaaatgcattgtgccacctggcatgaatacgtattagtgaaatgataagatattcctgtggcattttagcttgagagtctctgggttctgggagatttccctactcccttttaaaatgccaaggcacctataatttgcattgtgggtgttttacagttggtcttcttagccctctttcattggagaagaaatcatgggtatgccccagcgttttcctgtttctttgcttccttgtcacttggtgtgtggtgtgatcctggcaggatacagcaggagtttttcctgcatttcatgtggttccctgaatagccactaggtatcttggtgaattgcacaatctagcgaaaccactgaagtttcatcattcgtttctactgacttccagataatcggagtcaaccttctaaccttctagtctcacttcttccaaataatactgtacagactggggagaattattctacccactccctcatttcatgcttgtctgccttcctctcgaaggctcgtatgatgaaaattgcaaaaacccagctagtgcttctgcctgtttcctcattcaaaataggaagatggtcatacctaatgtcttgaggatcatggatagaatatgtggagaagacatagaaatagcctaattaaaggtcacagcatgactgcaacttttacaaatcattgaaaata

SEQ ID NO: 319749 - DNA, 1833 bp, Homo sapiens
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggtaagcaagtgcacccctagggaccctgcgctcagcccctcgcgcgcgctgagtttccaagaaaagttttctcgctttgaggttggcgaggggatgcagggtgtgggctcggtgcctcttctgagtgacttggaaaagaaagggcagacgatggttctgggtgctactctgctactctgctcctctgccggactgttgctgcggggctgggaggataggcttctcatctccttccccaagcgcccaccgcctccccgtgcgtcttgcaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagtgctgattctggctatgctctctttaagagtttgagtgcaaatagagagcccgtgggctcaacatctgatgtaataaacattactgcaacaaattgcttatgcacgttcattgggggagatgcagttttatctttcctaaaaggtcagacttttcatttgaaatgcattgtgccacctggcatgaatacgtattagtgaaatgataagatattcctgtggcattttagcttgagagtctctgggttctgggagatttccctactcccttttaaaatgccaaggcacctataatttgcattgtgggtgttttacagttggtcttcttagccctctttcattggagaagaaatcatgggtatgccccagcgttttcctgtttctttgcttccttgtcacttggtgtgtggtgtgatcctggcaggatacagcaggagtttttcctgcatttcatgtggttccctgaatagccactaggtatcttggtgaattgcacaatctagcgaaaccactgaagtttcatcattcgtttctactgacttccagataatcggagtcaaccttctaaccttctagtctcacttcttccaaataatactgtacagactggggagaattattctacccactccctcatttcatgcttgtctgccttcctctcgaaggctcgtatgatgaaaattgcaaaaacccagctagtgcttctgcctgtttcctcattcaaaataggaagatggtcatacctaatgtcttgaggatcatggatagaatatgtggagaagacatagaaatagcctaattaaaggtcacagcatgactgcaacttttacaaatcattgaaaata

SEQ ID NO: 319750 - DNA, 392 bp, Homo sapiens
  misc_feature (33)..(33): n is a, c, g, or t
  misc_feature (42)..(42): n is a, c, g, or t
aagtaaagtgaaatacaaagtaccatagagagnaaaaaatanccctggaattcagggagcatcatgtacccttctgttgagaggcatgaaaattagaaaaggatcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaa

SEQ ID NO: 319751 - DNA, 3060 bp, Homo sapiens
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaa

SEQ ID NO: 319752 - DNA, 695 bp, Homo sapiens
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccacccccccagtcctggcgttttctggctgactcatgcaaatgaggcgagaaccacttggacctctccaagttggctccaacaccaactggccttccttttcaggagtttaacttctggtgattttcaggattccctagtttttctcacttaaaggaacacgccaagaaacacacacattttatttaccccttcccctctaccactccccccaccttttttgttgttgttgtcaaataaggggacttgctttggtgtgtgatttttacggcctgtcctttcttgacagtagccctcggctacttcgcagcctttggttggggaaatggaaaaaaaa

SEQ ID NO: 319753 - DNA, 3277 bp, Homo sapiens
  misc_feature (3277)..(3277): n is a, c, g, or t
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaaaaaaaaaaaaaagggggccaaaaaaaccacaagggccaacttatcgatccatttgtgcaaggccacagaggcgacaaaaaaggcaggcgcggtaacacgcgcggaacgactggactgtgacgacacttgggcaaggaaccacaaagacggaaaaacgatggacacacgcgagtgtatatatataaacgcagacaaaaaaacacgacagacgaaatan

SEQ ID NO: 319754 - DNA, 3304 bp, Homo sapiens
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaaaaaaaaaatattatattattaataataattttatttatattataattataaactctaaaatattttattatcttcttcattcctttcataaatgaattgcccgtgtttttacacctacttctcggtaccctggggttccccaatttaattcctttgatacaattccctctttccacattgggtttttcttatagtgcccttccttattgcctttccagttggccatcctttatggctaatggct

SEQ ID NO: 319755 - DNA, 3003 bp, Homo sapiens
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcactgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaa

SEQ ID NO: 319756 - DNA, 2933 bp, Homo sapiens
tggaagttctgaaagggtgtaaggaaagaagtagggaaagcctcttggctgccagacgtaatagaggtccctctctgagttgacaccactgcaggaaaatgttatctctggattcccctgagttaaggtcggcagaggctgctggagaaatttatctgtcaaaggattttcctgaggtagttgcagcttccaaaatgcctccaaagacaggtggcacccgtttttttaaattatttaattatatatatatattatatatatatacacacacacacacacacacacacacacatatatgagtgtatctgtctatctttttaaaagcatgacctacagacttaaaacagccaaccaggaaacactattccacttttttttttcttttctcatttctcattgctaataaatgtcccaaaggtgggacttctctgacctcaccgctgactaaggctcttttccttccagactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaa

SEQ ID NO: 319757 - DNA, 2999 bp, Homo sapiens
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagaggcatggagagcagattcagggtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaa

SEQ ID NO: 319758 - DNA, 1803 bp, Homo sapiens
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtggtcctcagcgtgtgcagtatggggacttcggcgtgtgcagggctaccgagtgctcgaatttcgtaagtcgatggatcattagct

SEQ ID NO: 319759 - DNA, 1048 bp, Homo sapiens
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcactccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaa

SEQ ID NO: 319760 - DNA, 1335 bp, Homo sapiens
accgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggtaagcaagtgcacccctagggaccctgcgctcagcccctcgcgcgcgctgagtttccaagaaaagttttctcgctttgaggttggcgaggggatgcagggtgtgggctcggtgcctcttctgagtgacttggaaaagaaagggcagacgatggttctgggtgctactctgctactctgctcctctgccggactgttgctgcggggctgggaggataggcttctcatctccttccccaagcgcccaccgcctccccgtgcgtcttgcaggagacctacaaattgccgcaccggctcatcgagaaaaagagacgtgaccggattaacgagtgcatcgcccagctgaaggatctcctacccgaacatctcaaacttacagtaagtgagaagctggcccctttccaacccagtcctttgcccagagggcgggcgggtcactcgccgcctgcaggttccgcggggaactgcagaccagactggcggatcagagctggcgggtggctctgcggtggggtcctcctccacagtcctggcgttttctggctgactcatgcaaatgaggcgagaaccacttggacctctccaagttggctccaacaccaactggccttccttttcaggagtttaacttctggtgattttcaggattccctagtttttctcacttaaaggaacacgccaagaaacacacacattttatttaccccttcccctctaccactccccccaccttttttgttgttgttgtcaaataaggggacttgctttggtgtgtgatttttacggcctgtcctttcttgacagtagccctcggctacttcgcagcctttggttggggaaatggaaaaaaaa

SEQ ID NO: 319761 - DNA, 353 bp, Homo sapiens
aggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggtaagttggcactccttggcccttcaagcctcaactgcagccccatgttatgcgccactctcaacttg

SEQ ID NO: 319762 - DNA, 5115 bp, Homo sapiens
  misc_feature (1179)..(1179): n is a, c, g, or t
  misc_feature (1181)..(1181): n is a, c, g, or t
  misc_feature (2427)..(2427): n is a, c, g, or t
  misc_feature (3039)..(3039): n is a, c, g, or t
  misc_feature (3291)..(3291): n is a, c, g, or t
  misc_feature (3327)..(3327): n is a, c, g, or t
agtacccctatctgaaatgcttgagaccagaagtgttttggagttcagattttcttttggattttggaatatttgcagaatacctactgattgagcatatctaacctggaaatccaaagtgctccggtgaacattttctttgagcatcatgtcaatcaatggtcaaaaagttcaggattttggagcttcttggattatgggtgctcaacctgtataggaaacgtggagatggagcatgaatcagttgtatttgatacttgctggggaaaggatttccagaccaccagagaagaaggatcacccatttaacttggtgtatccagtgccatatcagagccttttcttccattttaacctcaccagtagtctttagatttgtggtttatgatcaagaaattaaatcctagaatacagattagtagagcaaagttgaggcttttgattatctatttcttttaaggtttttcgctttaacactttacagaagaatttctagactgtctgagaagaatactccaggtatttgtcccagtcttaaaatggttcaacaaaaagttcataatcactttttagaacccttttcccaaagaactgtgatcctacgtgtaacttaaaaaaagaaaacacacaaatgcttgcatcttttttcacatatttatctgtattcagcaatcaagaatagctggtactgatggatatctttacatgatttttcgttatttatctgaaaataatatatattgggtcattatttggcttttcaacctcagtaattcagtaactttctttcagttaattttgttgacctgttttggacacttttcaaaatattcttagcatgattttactgggaagaacacattattacaagagttaggcagtctgagtccacctccatttgtgtccatcctctctcgtttgtttattgaatgccttcacctgtgctctgaattgcatctctttccttctcaggaaattttatacattgtcaattattccttctctctaacttcaacctcgccttctttgctgagtctgacccatcaacagttaaacatgatcaagtcttccgatttaaaagtccctctttcttgacacagctcatttatagccaaacttctttctgaagagtagtctacattcattttctttttctccctcacttctgataatattgancnaactccattttagtttctgtccctatcattcctctaaattgattaaggtctccagaatattcctctgtatttacgggcattattcactgctcttcttatttgactactcagcaagcatttaacttttgatcagtttttccttaaaatactttacttggcttccttgacatcatggtttttgttcagatctctgtggttatttctgtctcctttgctgccttctcctcttggtccttgaattttagaattcttcaaatttcagttctagacaatcttctgttcttactcttagctttccctatgtggtctcatcatttctcatgtggacatagtagtctccccacttttatttttgccaccttacaattttatccacagagcagctagagtagtctataaattctttttaaaatacgtaaaatcactcactgcttagacactacataatctagtccttggctgcttctctgaccctgtcttataccagtctgcatttactacagtccatctatactggcctctttgaactgttcttcagatatgataagcttgtccttgctaaaagctctaactgttatttctgcttggaatgctcttctcgtctactcttcctatgcctagcattttcttaatgtttaggtctcacctgagatgtcactttcactgtagtactagtagttgatgttactactgattcgttggcagtattcctgaaatagaatataggataaatgaggacatgtttattttgttcacagctgtgtccacaaaatctaaacagtgcctgtagtactgtaggagctcattaagtagtcggctgattgatttttgtacctaatggttctattaacaatattgacccccaaatgtattttcttcataaccttctcctctgaactccagtctgtatatttaactgtctacctgacatttccacttctaagcttaaaagctcctccaattgaacctgtgatctctttaaatctgggactccaggatttcctgccacagtgaatggatttaccttttatctatctctgtaagctagaaagttgagagtcttcttcaatgccttctttccccctcatattcaatccatcaaatggattctatggactttgccacctgaatatctcttgaatctgttcctacattttaaactaccatcatttgatggattttcacacagtgagtgtatctatataattaatacccaggtcaggaaatacgatattactagcacctnagaagctccttgtgccctctctctgtcagagtgatctttttaaagggaaaatgtgatcatgcttaatgcctttcagttgcttcccattgctcttagaataaagaccagaaatcataatgtgatatttaagatcctggatgatgttactgtttttcctatgcaacttcatgttttttaaattatttttctcactttctgtattccagccctgataaccacctctcaattccttgaatgtggtatgctgttccctcttgctaaaaaattctatgtacacataccccttccgttcttgtccttcagatttgagctcttcaaagttttcttggacatagcaagcttgatgaggtcccaaatacatcttatgtgctctcatatgctttattcatttgtatattattatttcccttatttttaagctaatgagtcaggtattacacctgttttgctcactgttgcttggtcatcagctagcatggtggctgggaaagattagtattcaatattcatacaataagtgaatatgagtagtttgggtttgttatgggatgaattatccatccccaccccccactcccacacacagacacccaactgatacactgaagattnaaattctaactgtagaacctagaatgtaactgtatttggagatggggcctttaaaaaggtaatgaagataaaatgaagtcatatgggtggactccaattccatatgagtggtttccattaagaagagattaggacacagacacacagaaaggtaagaccatgtgaagacactggaggaagatggccatctacaagccaaagagatctacaggctttagaagaaaccaacactgctgacaccttgatcttggncttctagaagtgtgagaaaataaattctgttctttnaactacccaatctgtgatactttgctatggaagccctagtaaacttatatggattttggtattgggaaagtggggtgctggtgtaattaatacctaaaaatgtggaattggctttagaactagataatgggtagaggccagaagaagtatttgttagaaaaagcatagactgccttgaagagattgttggtagacatatggatgttgaaggtgattctggtgaagcttagaaaataggagagctgttgagaaagcttctgtcatcttagaggtatacatatgtcaccttgaataaatattggtagaaatatgaatgttaaaggtgtttctggtaggaactcaaacaaatgaggaatatattgttggaaactgagggaaaggcaatgcttattataatgtggcaaatagccaaattgtgttttgtggaaagtggatgaacttacaaagtgatgaacttgaatgtttagctgagatttctaagcaatgcattaaagatatggcctggtttcttcttgctgcttaaagtaagatgcaagaggagagagagaaatttaagaaggaattattaagccaaaagcaaccagagcctgaagattcggaaaattctcagtctatccatattgcaaaaatttagcatgttctggagggaacatcaaagttgttgcaagacaaccatttcctaaagcaattagggatatgtgacttgtggatccaatcagccatcttggcagcaactagcagaagccaggatagagatggggttatacctatggaaatgctgctggctggtaccgaagggaacagagggataaaaatgaaggaagtctgttggatttcttgagattctataaaatgggtcagtagagctatctggctgtgaacatgtgttcttcaagaagagggaagaatgaccctgaagatgattgagaaggcaaaggggctactattgctaccacaggaccagagggctcaggcctgaggagtcaaggtaggctacttcttagggctgagggaggtgggctaccacactggtgggctcagaagacagggctgccacccctgttaggtgggaagatggagaatgaagctgaagaagattattcttgagccttaaaatctaatgggatttgcctttatacgtttcagacctgcttaggatccatcaccccttctttctgatttttttggaataggaatgtttatcctatgcctgtctcaccagtggtgtattttggaagcaaataacttgtctagtttcacaggttcatgctggagaagaattttgcctcagggtgaaaccttgagtatgcctgtacctgatctaaatgatatttagatgagatttggggcttagagttgatactgaagtgggtcaagactttggggctgttgggatggagtggatgtgttttgtgtctgagaaggacatgaattttgaggggccagatggcagaattttaggggttgaattgtatgctctccaaatgtatataagttaaagtcctaactcctagtacctagaatgtgaccatatttggagatggggcctttaaaaaggtaattaagataaaatgacgttatacatatgagccctaatccaatatgaatggtgtctttgtaagaggttaggacaaacacaaagggaagatcatgtgatgacactggagaaagaaggccatctacaaactgaggagggaggcctgagaagagataaaccctgtggacatcttaatcttggacatctagccttcagaagtgtgggaaaataaatttctattgtttaagcca

SEQ ID NO: 319763 - DNA, 802 bp, Homo sapiens
acttccccaaagtggaactttcctaagtcaaattgcaataagggtctgtctcttctcctttcagatccctggaacatcatctgtagttcagagaaaatggaagcccctgcagcctgtttcacagcctcgagggccaggacagccaacgaagtcccggatgagcgctgtggcggctgaaataaagcagatccgagccagaaggaaaacagcccggatgttgatggttgtgcttttggtatttgcaatttgctatctaccaattagcatcctcaatgtgctaaagagagtatttgggatgtttgcccatactgaagacagagagactgtgtatgcctggtttaccttttcacactggcttgtatatgccaatagtgctgcgaatccaattatttataattttctcagtggaaaatttcgagaggaatttaaagctgcgttttcttgctgttgccttggagttcaccatcgccaggaggatcggctcaccaggggacgaactagcacagagagccggaagtccttgaccactcaaatcagcaactttgataacatatcaaaactttctgagcaagttgtgctcactagcataagcacactcccagcagccaatggagcaggaccacttcaaaactggtagaatatttattcatatgacaaggatacctgagtaaaactatcctttttaaaatcactgggaacagaaattttattatcctatgatgtgaagctaaaattacttgtggatcttttttttttttaatctattgctctttggaaataaaaaaaaagtcagtttaaaatg

SEQ ID NO: 319764 - DNA, 1859 bp, Homo sapiens
ctactactactaggccacgcgtcgactagtacgggggggggggggtaattgagcttcagctgagccggacgtagctttctcctcctggtgtcattgctgcagcctccagtgccgggtccctagttcctcagctgcctatcttcccggtgcaacatcgcctgtaaagacagcaaagccaccgcagaagttgcccggcagaagactccggaggcattggctcagtaacttttcacgtcattttctgctcgggagccccttctagcctctccgcgcagcctttcccaccgcaaatcaccagtgctcatggggcaggcggagaggagcttgcagcattgagcggaaccggacttgagcccgtgatgtccggcaccaaattggaggactcccccccttgtcgcaactggtcatctgcttcggagctgaatgaaactcaagagccctttttaaaccccaccgactatgacgacgaggaattcctgcggtacctgtggagggaatacctgcacccgaaagaatatgagtgggtcctgatcgccgggtacatcatcgtgttcgtcgtggctctcattgggaacgtcctggtttgtgtggcagtgtggaagaaccaccacatgaggacggtaaccaactacttcatagtcaatctttctctggctgatgtgctcgtgaccatcacctgccttccagccacactggtcgtggatatcactgagacctggttttttggacagtccctttgcaaagtgattccttatctacagaccgtgtcggtgtctgtgtctgtcctcacactgagctgtatcgccttggatcggtggtatgcaatctgtcaccctttgatgtttaagagcacagcaaagcgggcccgtaacagcattgtcatcatctggattgtctcctgcattataatgattcctcaggccatcgtcatggagtgcagcaccgtgttcccaggcttagccaataaaaccaccctctttacggtgtgtgatgagcgctggggtggtgaaatttatcccaagatgtaccacatctgtttctttctggtgacatacatggcaccactgtgtctcatggtgttggcttatctgcaaatatttcgcaaactctggtgtcgacagatccctggaacatcatctgtagttcagagaaaatggaagcccctgcagcctgtttcacagcctcgagggccaggacagccaacgaagtcccggatgagcgctgtggcggctgaaataaagcagatccgagccagaaggaaaacagcccggatgttgatggttgtgcttttggtatttgcaatttgctatctaccaattagcatcctcaatgtgctaaagagagtatttgggatgtttgcccatactgaagacagagagactgtgtatgcctggtttaccttttcacactggcttgtatatgccaatagtgctgcgaatccaattatttataattttctcagtggaaaatttcgagaggaatttaaagctgcgttttcttgctgttgccttggagttcaccatcgccaggaggatcggctcaccaggggacgaactagcacagagagccggaagtccttgaccactcaaatcagcaactttgataacatatcaaaactttctgagcaagttgtgctcactagcataagcacactcccagcagccaatggagcaggaccacttcaaaactggtagaatatttattcatatgacaaggatacctgagtaaaactatcctttttaaaatcactgggaacagaaattttattatcctatgatgtgaagctaaaattacttgtggatcttttttttttttaatctattgctctttggaaataaaaaaaaagtcagtttaaaatg

SEQ ID NO: 319765 - DNA, 241 bp, Homo sapiens
ttgcctcatcctacagagagactaagtaacttttacccaaggctacatagctgggagcagagtggggcttttgcctttcttccacagtgcctcttaccataacatacctttgttcaaggccttcagtcatctgcagttcccttttggggccccctttcccattgtacttttttgtttttttgagcactaacaaacgggaactactaatgttcagttatttgttgctatcttacaaaaccat

SEQ ID NO: 319766 - DNA, 754 bp, Homo sapiens
  misc_feature (754)..(754): n is a, c, g, or t
agtgacttactatacatgttgaagtgctctgatggaaggaacagaaacctctgaaaggaagccgtcaaagtaggaactgccaacaaaaatgtgttatatgagtctacactgtgatgaaatggggagtgattgaggattggggcctaataaaaagcacctgtctggaagccatggcacctgatgtttctgaggtgtcacaggaatagagtagaatcacgaaaagagagagaacctcctcgcatccggcagcacacctaacgttcattggcacagtggcctcatcagcacctctgacgtgatctaactatccctgtcttcttgtttccttcaagtccttctggaatctcctttctaagatgggagtaaagatacaaaggaaatcgcaaaaaaaaaaaaaaaaaaaaaaaaaaaaaacatttgttggggggccgtgggcccttggaaaaggtttttaaaacctttggttggggggggggggcccgtggggttatgtggaaagtgggccaaaacaggggtttaccgagaggaaaaacacgcgggcgccgaggaaccagcggcgctgggggatattccctcacccaaattaaaaaaaaagcgcgccggggcgggaaacacgcgaacggtttgtgggaaacacaatctcgcgagaggggagctccgggagaagcacaaagaggagggactctaaccacgagggggacccaagagcgaagttcggaaatagaaaattgccgggcgccggccgggggcagcn

SEQ ID NO: 319767 - DNA, 296 bp, Homo sapiens
aagctgaatttatcctcctgcttaaacaagaggaaaacagaacaaaacctgtgactggttttcagacattaaacaacaggcaatgtgagactgtgatgtcaagaagatagtaactggctacaattggtgagagccattttcaggctgtaggacggggaggatgaatccaaacacagaccagcagttctattgagttgcggagtcagagactagagatcagagaagccaaggcagctaaaacttgaggggcagagaaaccaggagcaaaaggattatatacacagagagaactccag

SEQ ID NO: 319768 - DNA, 1586 bp, Homo sapiens
agtccctcttgcgtcgaggctgcaaaatggttccattcgccaggagacgctcctgagagaagggcgcgcgcggcacaggggccttccttgcacctcggagcaaagcagctcggatagcgccacacgtctgcgccctgcgtgggaagggcagggctgacagcacttcctccccggggcagagacctggagcccgggtgcggcagtctgcaccgcgcgtcgctttcccggccggagtctcgccgccttcccgcgccccgcagcgccccgcagagcagtcgagatgggtgagtcaagtgaagacatagaccaaatgttcagcactttgctgggagagatggatcttctgactcagagtttaggagttgacactctccctcctcctgaccctaatccacccagagctgaatttaactacagtgtggggtttaaagatttaaatgagtccttaaatgcactggaagaccaagatttagatgctctcatggcagatctggtagcagacataagtgaggctgagcagaggacaatccaggcacagaaagagtccttgcagaatcaacatcattcagcatctctacaagcatcaattttcagtggtgcagcctctcttggttatggaacaaatgttgctgccactggtatcagccaatatgaggatgacttaccacctccaccagccgatcctgtgttagaccttccactgccaccaccacctcctgaacctctctctcaggaagaggaagaagcccaagccaaggctgataaaattaagctggcgctggaaaaactgaaggaggccaaggttaagaagctcgtcgtcaaggtgcacatgaatgataacagcacaaagtcactgatggtggatgagcggcagctggcccgagatgttctggacaaccttttcgagaaaactcattgtgactgcaatgtagactggtgtctttatgaaatctacccggaactacaaattgagaggttttttgaagaccatgaaaatgttgttgaagtcttatcagactggacaagagacacagaaaataaaatactatttttggagaaagaattcagaaggagtcccagtatatcaagtatctctgctgtgatgacacaagaacccttaaccagtgggtcatgggaatacggatagccaagtatgggaagactctctatgataactaccagcgggctgtggcaaaggctggacttgcctctcggtggacaaacttggggacagtcaatgcagctgcaccagctcagccatctacaggacctaaaacaggcaccacccagcccaatggacagattccccaggctacacattctgtcagtgctgttctccaagaggcccagagacatgctgaaacatcgaaggtaaaaccagcaagcagctgacccctataagccatgttctaaaccattcacattattccagtaactgctcttttaaaaagagaaaataagctgagtgcagtagctcacacctgtagtcccggaactttgggaggctgaggcaggaggatcacttgagcttcagtttgagaccagactggacaatatagcgagagcttgtctctactaaaaaaaaa

SEQ ID NO: 319769 - DNA, 1308 bp, Homo sapiens
agtccctcttgcgtcgaggctgcaaaatggttccattcgccaggagacgctcctgagagaagggcgcgcgcggcacaggggccttccttgcacctcggagcaaagcagctcggatagcgccacacgtctgcgccctgcgtgggaagggcagggctgacagcacttcctccccggggcagagacctggagcccgggtgcggcagtctgcaccgcgcgtcgctttcccggccggagtctcgccgccttcccgcgccccgcagcgccccgcagagcagtcgagatgggtgagtcaagtgaagacatagaccaaatgttcagcactttgctgggagagatggatcttctgactcagagtttaggagttgacactctccctcctcctgaccctaatccacccagagctgaatttaactacagtgtggggtttaaagatttaaatgagtccttaaatgcactggaagaccaagatttagatgctctcatggcagatctggtagcagacataagtgaggctgagcagaggacaatccaggcacagaaagagtccttgcagaatcaacatcattcagcatctctacaagcatcaattttcagtggtgcagcctctcttggttatggaacaaatgttgctgccactggtatcagccaatatgaggatgacttaccacctccaccagccgatcctgtgttagaccttccactgccaccaccacctcctgaacctctctctcaggaagaggaagaagcccaagccaaggctgataaaattaagctggcgctggaaaaactgaaggaggccaaggttaagaagctcgtcgtcaaggtgcacatgaatgataacagcacaaagtcactgatggtggatgagcggcagctggcccgagatgttctggacaaccttttcgagaaaactcattgtgactgcaatgtagactggtgtctttatgaaatctacccggaactacaaattgagaggttttttgaagaccatgaaaatgttgttgaagtcttatcagactggacaagagacacagaaaataaaatactatttttggagaaagaggagaaatatgctgtatttaaaaacccccagaatttctacttggataacagaggaaaaaaagaaagcaaggaaactaatgagaaaatgaatgctaagaacaaggaatccttacttgaggaaagtttctgtggaacatctatcattgtaccagaactggaaggagctctttatttgaaagaagatggaaagaaatcctggaaaaggcgctattttcttttacgggcttctggaatttattatgtacc

SEQ ID NO: 319770 - DNA, 1108 bp, Homo sapiens
agtccctcttgcgtcgaggctgcaaaatggttccattcgccaggagacgctcctgagagaagggcgcgcgcggcacaggggccttccttgcacctcggagcaaagcagctcggatagcgccacacgtctgcgccctgcgtgggaagggcagggctgacagcacttcctccccggggcagagacctggagcccgggtgcggcagtctgcaccgcgcgtcgctttcccggccggagtctcgccgccttcccgcgccccgcagcgccccgcagagcagtcgagatgggtgagtcaagtgaagacatagaccaaatgttcagcactttgctgggagagatggatcttctgactcagagtttaggagttgacactctccctcctcctgaccctaatccacccagagctgaatttaactacagtgtggggtttaaagatttaaatgagtccttaaatgcactggaagaccaagatttagatgctctcatggcagatctggtagcagacataagtgaggctgagcagaggacaatccaggcacagaaagagtccttgcagaatcaacatcattcagcatctctacaagcatcaattttcagtggtgcagcctctcttggttatggaacaaatgttgctgccactggtatcagccaatatgaggatgacttaccacctccaccagccgatcctgtgttagaccttccactgccaccaccacctcctgaacctctctctcagctcgtcgtcaaggtgcacatgaatgataacagcacaaagtcactgatggtggatgagcggcagctggcccgagatgttctggacaaccttttcgagaaaactcattgtgactgcaatgtagactggtgtctttatgaaatctacccggaactacaaattgaatttctacttggataacagaggaaaaaaagaaagcaaggaaactaatgagaaaatgaatgctaagaacaaggaatccttacttgaggaaagtttctgtggaacatctatcattgtaccagaactggaaggagctctttatttgaaagaagatggaaagaaatcctggaaaaggcgctattttcttttacgggcttctggaatttattatgtacc

SEQ ID NO: 319771 - DNA, 1561 bp, Homo sapiens
agtccctcttgcgtcgaggctgcaaaatggttccattcgccaggagacgctcctgagagaagggcgcgcgcggcacaggggccttccttgcacctcggagcaaagcagctcggatagcgccacacgtctgcgccctgcgtgggaagggcagggctgacagcacttcctccccggggcagagacctggagcccgggtgcggcagtctgcaccgcgcgtcgctttcccggccggagtctcgccgccttcccgcgccccgcagcgccccgcagagcagtcgagatgggtgagtcaagtgaagacatagaccaaatgttcagcactttgctgggagagatggatcttctgactcagagtttaggagttgacactctccctcctcctgaccctaatccacccagagctgaatttaactacagtgtggggtttaaagatttaaatgagtccttaaatgcactggaagaccaagatttagatgctctcatggcagatctggtagcagacataagtgaggctgagcagaggacaatccaggcacagaaagagtccttgcagaatcaacatcattcagcatctctacaagcatcaattttcagtggtgcagcctctcttggttatggaacaaatgttgctgccactggtatcagccaatatgaggatgacttaccacctccaccagccgatcctgtgttagaccttccactgccaccaccacctcctgaacctctctctcaggaagaggaagaagcccaagccaaggctgataaaattaagctggcgctggaaaaactgaaggaggccaaggttaagaagctcgtcgtcaaggtgcacatgaatgataacagcacaaagtcactgatggtggatgagcggcagctggcccgagatgttctggacaaccttttcgagaaaactcattgtgactgcaatgtagactggtgtctttatgaaatctacccggaactacaaattgagaggttttttgaagaccatgaaaatgttgttgaagtcttatcagactggacaagagacacagaaaataaaatactatttttggagaaagaattcagaaggagtcccagtatatcaagtatctctgctgtgatgacacaagaacccttaaccagtgggtcatgggaatacggatagccaagtatgggaagactctctatgataactaccagcgggctgtggcaaaggctggacttgcctctcggtggacaaacttggggacagtcaatgcagctgcaccagctcagccatctacaggacctaaaacaggcaccacccagcccaatggacagattccccaggctacacattctgtcagtgctgttctccaagaggcccagagacatgctgaaacatcgaaggataagaagccagccctcgggaaccaccacgacccggcagtgccccgggccccgcacgcccccaagtccagcctgcccccgcgacctccggtgcggaggtcctccgacaccagcggcagtcccgccacgcccctcaaggccaagggcacaggcggcgggggcttgcccgccccacccgacgacttcctgc

SEQ ID NO: 319772 - DNA, 4465 bp, Homo sapiens
ctaggagcgaagcgtgcacgccttgtctttctccacctttcgtctttggtcacagcgccatctcatggttagctgaaactttgaaagaggattcattcttcagaggcaaggaatcggagtcctatgtctttctcgcgccttgaaggttacttagctaaagctaagatagcgagaaacagtacttttcaggtccttccatgatctacattcgtccttgttctcggaggacccagactctatggttaatgatgaagaggggcctctattcgttcagcgcttgcgcatgcgaggaggttccgcatgcgcggtggagtgagcgaagcgcacgctgaggaggatcggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatttgaagttacagctacagtagtcaggtgtagaaaatcttgagttgctttggtctgcttgtcttcataaatttattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaagttttaacttccagtggctggtttctgagagagtgccatgattgctagccagcattccatattgggaatatgtagaggagaacctggatgtacttaagagtggcatataattttcacttctgtctgttgaggcatcaaaaaaacaagtttagaaagctggcaacatgaagaatgcattcaaaatataacaggtgcttctttgttgtacgcagaggaattttttcttttgattttgtttactgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctcaaaaaaaaaaaaaaaaaccaaaaatcttgaatctcccatcaaagccttttcattaaaaatacaatttcatctactccctactgtacctttcactgatgtcaagtggctatcaattcatatagctgaaaattagtgatagtttgggtctcatttatgcataaattaattgaaaatcagtaatggccaggaagaaatatgaatattcaaaccacttttttctttttttttttttttttttggcaaatggtgttatattgcctgggcaggtctcgaaatcctgggctcaagctatcctcctgcctctgcctctgtaagagtgtgagccaccatgccccacccaaaccatttttcatatcagttatagcaaaacaagacaaaccagttcttaataatgttcaaagttggacccatagagacatgctaagcactacatcatgctaagaagaacagttattactcagctgccatacttcagccattctacttttacaccaagaacaaaatggctagagatttttttaaaaatacaaatgccagtaccttgccgagacttgttcactgatttgccccaaccccaaggtaatggtcatctactttgcaacctatggagatcctgatagctcccatacaaagtgaggtacactgttgccaatttggaggcaggaagccatcaaactaaacgtagtttaattcagatgaacacctatcgatattcaaaaggcaaaacaaaaaaactaattccagggacattagaccttggtgaaatgccaaatggaaaatggtgctttaaaaggtagtctcttaccatataaggaataagtaaaacattagcttgtgatttctcattattcaggtcaatgttttagacacgactaacaagggacagttcaaactattaaagagaacaaatttttacttaagcactttgaggtatccactccccttaaatgtaagttatgtattttatctgttgattaaggggaggtccaagcatttgtacttggcaggaatgctggcaatagcttgtgccagattactgtataaacttgaaagtaataaaaatgttctttaaaagtaaaaaaaaaaaa

SEQ ID NO: 319773 - DNA, 4393 bp, Homo sapiens
ctaggagcgaagcgtgcacgccttgtctttctccacctttcgtctttggtcacagcgccatctcatggttagctgaaactttgaaagaggattcattcttcagaggcaaggaatcggagtcctatgtctttctcgcgccttgaaggttacttagctaaagctaagatagcgagaaacagtacttttcaggtccttccatgatctacattcgtccttgttctcggaggacccagactctatggttaatgatgaagaggggcctctattcgttcagcgcttgcgcatgcgaggaggttccgcatgcgcggtggagtgagcgaagcgcacgctgaggaggatcggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaagttttaacttccagtggctggtttctgagagagtgccatgattgctagccagcattccatattgggaatatgtagaggagaacctggatgtacttaagagtggcatataattttcacttctgtctgttgaggcatcaaaaaaacaagtttagaaagctggcaacatgaagaatgcattcaaaatataacaggtgcttctttgttgtacgcagaggaattttttcttttgattttgtttactgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctcaaaaaaaaaaaaaaaaaccaaaaatcttgaatctcccatcaaagccttttcattaaaaatacaatttcatctactccctactgtacctttcactgatgtcaagtggctatcaattcatatagctgaaaattagtgatagtttgggtctcatttatgcataaattaattgaaaatcagtaatggccaggaagaaatatgaatattcaaaccacttttttctttttttttttttttttttggcaaatggtgttatattgcctgggcaggtctcgaaatcctgggctcaagctatcctcctgcctctgcctctgtaagagtgtgagccaccatgccccacccaaaccatttttcatatcagttatagcaaaacaagacaaaccagttcttaataatgttcaaagttggacccatagagacatgctaagcactacatcatgctaagaagaacagttattactcagctgccatacttcagccattctacttttacaccaagaacaaaatggctagagatttttttaaaaatacaaatgccagtaccttgccgagacttgttcactgatttgccccaaccccaaggtaatggtcatctactttgcaacctatggagatcctgatagctcccatacaaagtgaggtacactgttgccaatttggaggcaggaagccatcaaactaaacgtagtttaattcagatgaacacctatcgatattcaaaaggcaaaacaaaaaaactaattccagggacattagaccttggtgaaatgccaaatggaaaatggtgctttaaaaggtagtctcttaccatataaggaataagtaaaacattagcttgtgatttctcattattcaggtcaatgttttagacacgactaacaagggacagttcaaactattaaagagaacaaatttttacttaagcactttgaggtatccactccccttaaatgtaagttatgtattttatctgttgattaaggggaggtccaagcatttgtacttggcaggaatgctggcaatagcttgtgccagattactgtataaacttgaaagtaataaaaatgttctttaaaagtaaaaaaaaaaaa

SEQ ID NO: 319774 - DNA, 4219 bp, Homo sapiens
ctaggagcgaagcgtgcacgccttgtctttctccacctttcgtctttggtcacagcgccatctcatggttagctgaaactttgaaagaggattcattcttcagaggcaaggaatcggagtcctatgtctttctcgcgccttgaaggttacttagctaaagctaagatagcgagaaacagtacttttcaggtccttccatgatctacattcgtccttgttctcggaggacccagactctatggttaatgatgaagaggggcctctattcgttcagcgcttgcgcatgcgaggaggttccgcatgcgcggtggagtgagcgaagcgcacgctgaggaggatcggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaagttttaacttccagtggctggtttctgagagagtgccatgattgctagccagcattccatattgggaatatgtagaggagaacctggatgtacttaagagtggcatataattttcacttctgtctgttgaggcatcaaaaaaacaagtttagaaagctggcaacatgaagaatgcattcaaaatataacaggtgcttctttgttgtacgcagaggaattttttcttttgattttgtttactgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctcaaaaaaaaaaaaaaaaaccaaaaatcttgaatctcccatcaaagccttttcattaaaaatacaatttcatctactccctactgtacctttcactgatgtcaagtggctatcaattcatatagctgaaaattagtgatagtttgggtctcatttatgcataaattaattgaaaatcagtaatggccaggaagaaatatgaatattcaaaccacttttttctttttttttttttttttttggcaaatggtgttatattgcctgggcaggtctcgaaatcctgggctcaagctatcctcctgcctctgcctctgtaagagtgtgagccaccatgccccacccaaaccatttttcatatcagttatagcaaaacaagacaaaccagttcttaataatgttcaaagttggacccatagagacatgctaagcactacatcatgctaagaagaacagttattactcagctgccatacttcagccattctacttttacaccaagaacaaaatggctagagatttttttaaaaatacaaatgccagtaccttgccgagacttgttcactgatttgccccaaccccaaggtaatggtcatctactttgcaacctatggagatcctgatagctcccatacaaagtgaggtacactgttgccaatttggaggcaggaagccatcaaactaaacgtagtttaattcagatgaacacctatcgatattcaaaaggcaaaacaaaaaaactaattccagggacattagaccttggtgaaatgccaaatggaaaatggtgctttaaaaggtagtctcttaccatataaggaataagtaaaacattagcttgtgatttctcattatcgaagggtttcagatcagacgagatagaacagtgtcaaattattagaagtagacgaaaggttatc

SEQ ID NO: 319775 - DNA, 4114 bp, Homo sapiens
  misc_feature (3542)..(3542): n is a, c, g, or t
  misc_feature (3557)..(3557): n is a, c, g, or t
ctaggagcgaagcgtgcacgccttgtctttctccacctttcgtctttggtcacagcgccatctcatggttagctgaaactttgaaagaggattcattcttcagaggcaaggaatcggagtcctatgtctttctcgcgccttgaaggttacttagctaaagctaagatagcgagaaacagtacttttcaggtccttccatgatctacattcgtccttgttctcggaggacccagactctatggttaatgatgaagaggggcctctattcgttcagcgcttgcgcatgcgaggaggttccgcatgcgcggtggagtgagcgaagcgcacgctgaggaggatcggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaagttttaacttccagtggctggtttctgagagagtgccatgattgctagccagcattccatattgggaatatgtagaggagaacctggatgtacttaagagtggcatataattttcacttctgtctgttgaggcatcaaaaaaacaagtttagaaagctggcaacatgaagaatgcattcaaaatataacaggtgcttctttgttgtacgcagaggaattttttcttttgattttgtttactgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctcaaaaaaaaaaaaaacccaaaatattctgggatattcctcccctataaaagcctcttttcctattaaaaatatacacattttctattctaatctccctctaagtggtactctttccattggtatggtccaggtgggcttattcaattcctataaattaggctggaaaaattagtggataagttgggggtcctccatttttatggccattaatttcattgggaacactccagtatgggnccgaggaaggaattnatgcatttttacaaaccacttttttccttttttcttttttctttcggggggacaagcgggcgtgtcaattgtggccgggggaggggtcctccaaaaccgcggggcccaaagctatatctccgcgggcgttgcggcctcccttgtaaaaagtgtgttgagcccaactgtgggccccccacccgaagaacacttttcttctccttctacccggtttttgcgcaaacacgaagaaccaccccggttctattactggtgcccgaggtggggccctgggagatgtggtggcgccctattcttggttcagaggaccggtttttcaccagcggcatcatgctgctcctttctagttttcccaggcaccagggcctggcgagttctacacttcaatgcgctcctctgccgaagtgttccgggtgtgccccgccagggtgtgtctctggcccttgggatcttggccccaggggcggggcctgggggcccaccactgtttctcgacctgttcgcggaatcggccttggcggcggggtccccacgcttcttctacggatggatgctcg

SEQ ID NO: 319776 - DNA, 4235 bp, Homo sapiens
ctaggagcgaagcgtgcacgccttgtctttctccacctttcgtctttggtcacagcgccatctcatggttagctgaaactttgaaagaggattcattcttcagaggcaaggaatcggagtcctatgtctttctcgcgccttgaaggttacttagctaaagctaagatagcgagaaacagtacttttcaggtccttccatgatctacattcgtccttgttctcggaggacccagactctatggttaatgatgaagaggggcctctattcgttcagcgcttgcgcatgcgaggaggttccgcatgcgcggtggagtgagcgaagcgcacgctgaggaggatcggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaaagtggtcacagatacagatgagactgaacttgcgaggcagatggagaggcttgaaagagaaaatgccgaagtggactcctaaatgtcagctgttgtcacacagtagctccaacactttgagcatttttaagggagtggcctcatttcactagagacaaatctttaagaatagttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatttgaagttacagctacagtagtcaggtgtagaaaatcttgagttgctttggtctgcttgtcttcataaatttattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaagttttaacttccagtggctggtttctgagagagtgccatgattgctagccagcattccatattgggaatatgtagaggagaacctggatgtacttaagagtggcatataattttcacttctgtctgttgaggcatcaaaaaaacaagtttagaaagctggcaacatgaagaatgcattcaaaatataacaggtgcttctttgttgtacgcagaggaattttttcttttgattttgtttactgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctcaaaaaaaaaaaaaaaaaccaaaaatcttgaatctcccatcaaagccttttcattaaaaatacaatttcatctactccctactgtacctttcactgatgtcaagtggctatcaattcatatagctgaaaattagtgatagtttgggtctcatttatgcataaattaattgaaaatcagtaatggccaggaagaaatatgaatattcaaaccacttttttctttttttttttttttttttggcaaatggtgttatattgcctgggcaggtctcgaaatcctgggctcaagctatcctcctgcctctgcctctgtaagagtgtgagccaccatgccccacccaaaccatttttcatatcagttatagcaaaacaagacaaaccagttcttaataatgttcaaagttggacccatagagacatgctaagcactacatcatgctaagaagaacagttattactcagctgccatacttcagccattctacttttacaccaagaacaaaatggctagagatttttttaaaaatacaaatgccagtaccttgccgagacttgttcactgatttgccccaaccccaaggtaatggtcatctactttgcaacctatggagatcctgatagctcccatacaaagtgaggtacactgttgccaatttggaggcaggaagccatcaaactaaacgtagtttaattcagatgaacacctatcgatattcaaaaggcaaaacaaaaaaactaattccagggacattagaccttggtgaaatgccaaatggaaaatggtgctttaaaaggtagtctcttaccatataaggaataagtaaaacattagcttgtgatttctcattattcaggtcaatgttttagacacgactaacaagggacagttcaaactattaaagagaacaaatttttacttaagcactttgaggtatccactccccttaaatgtaagttatgtattttatctgttgattaaggggaggtccaagcatttgtacttggcaggaatgctggcaatagcttgtgccagattactgtataaacttgaaagtaataaaaatgttctttaaaagtaaaaaaaaaaaa

SEQ ID NO: 319777 - DNA, 3779 bp, Homo sapiens
cgggcgtagtttacagaggatggcacactcagactgtcaagacaacattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatttgaagttacagctacagtagtcaggtgtagaaaatcttgagttgctttggtctgcttgtcttcataaatttattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaagttttaacttccagtggctggtttctgagagagtgccatgattgctagccagcattccatattgggaatatgtagaggagaacctggatgtacttaagagtggcatataattttcacttctgtctgttgaggcatcaaaaaaacaagtttagaaagctggcaacatgaagaatgcattcaaaatataacaggtgcttctttgttgtacgcagaggaattttttcttttgattttgtttactgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctcaaaaaaaaaaaaaaaaaccaaaaatcttgaatctcccatcaaagccttttcattaaaaatacaatttcatctactccctactgtacctttcactgatgtcaagtggctatcaattcatatagctgaaaattagtgatagtttgggtctcatttatgcataaattaattgaaaatcagtaatggccaggaagaaatatgaatattcaaaccacttttttctttttttttttttttttttggcaaatggtgttatattgcctgggcaggtctcgaaatcctgggctcaagctatcctcctgcctctgcctctgtaagagtgtgagccaccatgccccacccaaaccatttttcatatcagttatagcaaaacaagacaaaccagttcttaataatgttcaaagttggacccatagagacatgctaagcactacatcatgctaagaagaacagttattactcagctgccatacttcagccattctacttttacaccaagaacaaaatggctagagatttttttaaaaatacaaatgccagtaccttgccgagacttgttcactgatttgccccaaccccaaggtaatggtcatctactttgcaacctatggagatcctgatagctcccatacaaagtgaggtacactgttgccaatttggaggcaggaagccatcaaactaaacgtagtttaattcagatgaacacctatcgatattcaaaaggcaaaacaaaaaaactaattccagggacattagaccttggtgaaatgccaaatggaaaatggtgctttaaaaggtagtctcttaccatataaggaataagtaaaacattagcttgtgatttctcattattcaggtcaatgttttagacacgactaacaagggacagttcaaactattaaagagaacaaatttttacttaagcactttgaggtatccactccccttaaatgtaagttatgtattttatctgttgattaaggggaggtccaagcatttgtacttggcaggaatgctggcaatagcttgtgccagattactgtataaacttgaaagtaataaaaatgttctttaaaagtaaaaaaaaaaaa

SEQ ID NO: 319778 - DNA, 3735 bp, Homo sapiens
ccaaaatactgagagcactttaaaaaagagtaacactttcttctatctgtacacatacaagttttatgaggtttgatcagaatctttcattagtgataaaattaactggatggctgtaactcagaaggattcttccatcagtttagttcagagacaaattatccattatactgatgataattgcagttagtttagccaccaaagatacacggaaatgataattctttctattcagtatcgcagtgaactgtttatactattgcattagatccctgtgttgatttggttaatacagcagattaataaaatctcaagcatcctaatagttgtgggttctgtaggtacattcataaatgaatttttgtctttctcttttagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatttgaagttacagctacagtagtcaggtgtagaaaatcttgagttgctttggtctgcttgtcttcataaatttattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaagttttaacttccagtggctggtttctgagagagtgccatgattgctagccagcattccatattgggaatatgtagaggagaacctggatgtacttaagagtggcatataattttcacttctgtctgttgaggcatcaaaaaaacaagtttagaaagctggcaacatgaagaatgcattcaaaatataacaggtgcttctttgttgtacgcagaggaattttttcttttgattttgtttactgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctcaaaaaaaaaaaaaaaaaccaaaaatcttgaatctcccatcaaagccttttcattaaaaatacaatttcatctactccctactgtacctttcactgatgtcaagtggctatcaattcatatagctgaaaattagtgatagtttgggtctcatttatgcataaattaattgaaaatcagtaatggccaggaagaaatatgaatattcaaaccacttttttctttttttttttttttttttggcaaatggtgttatattgcctgggcaggtctcgaaatcctgggctcaagctatcctcctgcctctgcctctgtaagagtgtgagccaccatgccccacccaaaccatttttcatatcagttatagcaaaacaagacaaaccagttcttaataatgttcaaagttggacccatagagacatgctaagcactacatcatgctaagaagaacagttattactcagctgccatacttcagccattctacttttacaccaagaacaaaatggctagagatttttttaaaaatacaaatgccagtaccttgccgagacttgttcactgatttgccccaaccccaaggtaatggtcatctactttgcaacctatggagatcctgatagctcccatacaaagtgaggtacactgttgccaatttggaggcaggaagccatcaaactaaacgtagtttaattcagatgaacacctatcgatattcaaaaggcaaaacaaaaaaactaattccagggacattagaccttggtgaaatgccaaatggaaaatggtgctttaaaaggtagtctcttaccatataaggaataagtaaaacattagcttgtgatttctcattattcaggtcaatgttttagacacgactaacaagggacagttcaaactattaaagagaacaaatttttacttaagcactttgaggtatccactccccttaaatgtaagttatgtattttatctgttgattaaggggaggtccaagcatttgtacttggcaggaatgctggcaatagcttgtgccagattactgtataaacttgaaagtaataaaaatgttctttaaaagtaaaaaaaaaaaa

SEQ ID NO: 319779 - DNA, 3302 bp, Homo sapiens
gagagaaaacattaggcagtaatagtattgaaattaaatttgtatagtatttactacttcagtttgaaattatacctctgcttccacagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatttgaagttacagctacagtagtcaggtgtagaaaatcttgagttgctttggtctgcttgtcttcataaatttattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaagttttaacttccagtggctggtttctgagagagtgccatgattgctagccagcattccatattgggaatatgtagaggagaacctggatgtacttaagagtggcatataattttcacttctgtctgttgaggcatcaaaaaaacaagtttagaaagctggcaacatgaagaatgcattcaaaatataacaggtgcttctttgttgtacgcagaggaattttttcttttgattttgtttactgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctcaaaaaaaaaaaaaaaaaccaaaaatcttgaatctcccatcaaagccttttcattaaaaatacaatttcatctactccctactgtacctttcactgatgtcaagtggctatcaattcatatagctgaaaattagtgatagtttgggtctcatttatgcataaattaattgaaaatcagtaatggccaggaagaaatatgaatattcaaaccacttttttctttttttttttttttttttggcaaatggtgttatattgcctgggcaggtctcgaaatcctgggctcaagctatcctcctgcctctgcctctgtaagagtgtgagccaccatgccccacccaaaccatttttcatatcagttatagcaaaacaagacaaaccagttcttaataatgttcaaagttggacccatagagacatgctaagcactacatcatgctaagaagaacagttattactcagctgccatacttcagccattctacttttacaccaagaacaaaatggctagagatttttttaaaaatacaaatgccagtaccttgccgagacttgttcactgatttgccccaaccccaaggtaatggtcatctactttgcaacctatggagatcctgatagctcccatacaaagtgaggtacactgttgccaatttggaggcaggaagccatcaaactaaacgtagtttaattcagatgaacacctatcgatattcaaaaggcaaaacaaaaaaactaattccagggacattagaccttggtgaaatgccaaatggaaaatggtgctttaaaaggtagtctcttaccatataaggaataagtaaaacattagcttgtgatttctcattattcaggtcaatgttttagacacgactaacaagggacagttcaaactattaaagagaacaaatttttacttaagcactttgaggtatccactccccttaaatgtaagttatgtattttatctgttgattaaggggaggtccaagcatttgtacttggcaggaatgctggcaatagcttgtgccagattactgtataaacttgaaagtaataaaaatgttctttaaaagtaaaaaaaaaaaa

SEQ ID NO: 319780 - DNA, 3143 bp, Homo sapiens
tcccaagatgagaaactggttggcacacgccagctaaataatttttagtgaattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatttgaagttacagctacagtagtcaggtgtagaaaatcttgagttgctttggtctgcttgtcttcataaatttattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaagttttaacttccagtggctggtttctgagagagtgccatgattgctagccagcattccatattgggaatatgtagaggagaacctggatgtacttaagagtggcatataattttcacttctgtctgttgaggcatcaaaaaaacaagtttagaaagctggcaacatgaagaatgcattcaaaatataacaggtgcttctttgttgtacgcagaggaattttttcttttgattttgtttactgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctcaaaaaaaaaaaaaaaaaccaaaaatcttgaatctcccatcaaagccttttcattaaaaatacaatttcatctactccctactgtacctttcactgatgtcaagtggctatcaattcatatagctgaaaattagtgatagtttgggtctcatttatgcataaattaattgaaaatcagtaatggccaggaagaaatatgaatattcaaaccacttttttctttttttttttttttttttggcaaatggtgttatattgcctgggcaggtctcgaaatcctgggctcaagctatcctcctgcctctgcctctgtaagagtgtgagccaccatgccccacccaaaccatttttcatatcagttatagcaaaacaagacaaaccagttcttaataatgttcaaagttggacccatagagacatgctaagcactacatcatgctaagaagaacagttattactcagctgccatacttcagccattctacttttacaccaagaacaaaatggctagagatttttttaaaaatacaaatgccagtaccttgccgagacttgttcactgatttgccccaaccccaaggtaatggtcatctactttgcaacctatggagatcctgatagctcccatacaaagtgaggtacactgttgccaatttggaggcaggaagccatcaaactaaacgtagtttaattcagatgaacacctatcgatattcaaaaggcaaaacaaaaaaactaattccagggacattagaccttggtgaaatgccaaatggaaaatggtgctttaaaaggtagtctcttaccatataaggaataagtaaaacattagcttgtgatttctcattattcaggtcaatgttttagacacgactaacaagggacagttcaaactattaaagagaacaaatttttacttaagcactttgaggtatccactccccttaaatgtaagttatgtattttatctgttgattaaggggaggtccaagcatttgtacttggcaggaatgctggcaatagcttgtgccagattactgtataaacttgaaagtaataaaaatgttctttaaaagtaaaaaaaaaaaa

SEQ ID NO: 319781 - DNA, 1704 bp, Homo sapiens
ctaggagcgaagcgtgcacgccttgtctttctccacctttcgtctttggtcacagcgccatctcatggttagctgaaactttgaaagaggattcattcttcagaggcaaggaatcggagtcctatgtctttctcgcgccttgaaggttacttagctaaagctaagatagcgagaaacagtacttttcaggtccttccatgatctacattcgtccttgttctcggaggacccagactctatggttaatgatgaagaggggcctctattcgttcagcgcttgcgcatgcgaggaggttccgcatgcgcggtggagtgagcgaagcgcacgctgaggaggatcggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaaagtggtcacagatacagatgagactgaacttgcgaggcagatggagaggcttgaaagagaaaatgccgaagtggactggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatattta

SEQ ID NO: 319782 - DNA, 2641 bp, Homo sapiens
cgagtatgggctatcgtcgaccacggcctcgcttttatcttagagtctcagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatttgaagttacagctacagtagtcaggtgtagaaaatcttgagttgctttggtctgcttgtcttcataaatttattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaagttttaacttccagtggctggtttctgagagagtgccatgattgctagccagcattccatattgggaatatgtagaggagaacctggatgtacttaagagtggcatataattttcacttctgtctgttgaggcatcaaaaaaacaagtttagaaagctggcaacatgaagaatgcattcaaaatataacaggtgcttctttgttgtacgcagaggaattttttcttttgattttgtttactgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctcaaaaaaaaaaaaaaaaaccaaaaatcttgaatctcccatcaaagccttttcattaaaaatacaatttcatctactccctactgtacctttcactgatgtcaagtggctatcaattcatatagctgaaaattagtgatagtttgggtctcatttatgcataaattaattgaaaatcagtaatggccaggaagaaatatgaatattcaaaccacttttttctttttttttttttttttttggcaaatggtgttatattgcctgggcaggtctcgaaatcctgggctcaagctatcctcctgcctctgcctctgtaagagtgtgagccaccatgccccacccaaaccatttttcatatcagttatagcaaaacaagacaaaccagttcttaataatgttcaaagttggacccatagagacatgctaagcactacatcatgctaagaagaacagttattactcagctgccatacttcagccattctacttttacaccaagaacaaaatggctagagatttttttaaaaatacaaatgccagtaccttgccgagacttgttcactgatttgccccaaccccaaggtaatggtcatctactttgcaacctatggagatcctgatagctcccatacaaagtgaggtacactgttgccaatttggaggcaggaagccatcaaactaaacgtagtttaattcagatgaacacctatcgatattcaaaaggcaaaacaaaaaaactaattccagggacattagaccttggtgaaatgccaaatggaaaatggtgctttaaaaggtagtctcttaccatataaggaataagtaaaacattagcttgtgatttctcattattcaggtcaatgttttagacacgactaacaagggacagttcaaactattaaagagaacaaatttttacttaagcactttgaggtatccactccccttaaatgtaagttatgtattttatctgttgattaaggggaggtccaagcatttgtacttggcaggaatgctggcaatagcttgtgccagattactgtataaacttgaaagtaataaaaatgttctttaaaagtaaaaaaaaaaaa

SEQ ID NO: 319783 - DNA, 1088 bp, Homo sapiens
ctaggagcgaagcgtgcacgccttgtctttctccacctttcgtctttggtcacagcgccatctcatggttagctgaaactttgaaagaggattcattcttcagaggcaaggaatcggagtcctatgtctttctcgcgccttgaaggttacttagctaaagctaagatagcgagaaacagtacttttcaggtccttccatgatctacattcgtccttgttctcggaggacccagactctatggttaatgatgaagaggggcctctattcgttcagcgcttgcgcatgcgaggaggttccgcatgcgcggtggagtgagcgaagcgcacgctgaggaggatcggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagaacgcgcctaatacgcagacgcgcctatacgcagacgcgcctataccgacgcgcctataccgacgcgccttatgtccg

SEQ ID NO: 319784 - DNA, 642 bp, Homo sapiens
ccaaaatactgagagcactttaaaaaagagtaacactttcttctatctgtacacatacaagttttatgaggtttgatcagaatctttcattagtgataaaattaactggatggctgtaactcagaaggattcttccatcagtttagttcagagacaaattatccattatactgatgataattgcagttagtttagccaccaaagatacacggaaatgataattctttctattcagtatcgcagtgaactgtttatactattgcattagatccctgtgttgatttggttaatacagcagattaataaaatctcaagcatcctaatagttgtgggttctgtaggtacattcataaatgaatttttgtctttctcttttagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggaggtgagatcaatagattcatttttaataatgactcaggaggttcctaaaaggagttcttgtaggtaaataagagctgtcggccttggaatgtcatattgtaggatggtcattcaggccttt

SEQ ID NO: 319785 - DNA, 789 bp, Homo sapiens
  misc_feature (10)..(10): n is a, c, g, or t
  misc_feature (27)..(28): n is a, c, g, or t
  misc_feature (708)..(708): n is a, c, g, or t
  misc_feature (770)..(770): n is a, c, g, or t
  misc_feature (774)..(774): n is a, c, g, or t
ttgtgttggncccggaattcggccctnntggccgggaagcttggataacgcagagtggcttttggcgggggaagcgcacgctgaggaggatcggcggccggtgagggggaagcaagtctggtctctgtgattgaagaagtcggctctgggctccagtgcgggaatcacacacatacctcagaatgccgggtctaagttgtagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaanaagttcatttttgttaataacactggtttcaaataatgatgttagacttaacctaatttatnaacnagaaattatatctcc

SEQ ID NO: 319786 - DNA, 4217 bp, Homo sapiens
  misc_feature (10)..(10): n is a, c, g, or t
  misc_feature (27)..(28): n is a, c, g, or t
ttgtgttggncccggaattcggccctnntggccgggaagcttggataacgcagagtggcttttggcgggggaagcgcacgctgaggaggatcggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatttgaagttacagctacagtagtcaggtgtagaaaatcttgagttgctttggtctgcttgtcttcataaatttattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaagttttaacttccagtggctggtttctgagagagtgccatgattgctagccagcattccatattgggaatatgtagaggagaacctggatgtacttaagagtggcatataattttcacttctgtctgttgaggcatcaaaaaaacaagtttagaaagctggcaacatgaagaatgcattcaaaatataacaggtgcttctttgttgtacgcagaggaattttttcttttgattttgtttactgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctcaaaaaaaaaaaaaaaaaccaaaaatcttgaatctcccatcaaagccttttcattaaaaatacaatttcatctactccctactgtacctttcactgatgtcaagtggctatcaattcatatagctgaaaattagtgatagtttgggtctcatttatgcataaattaattgaaaatcagtaatggccaggaagaaatatgaatattcaaaccacttttttctttttttttttttttttttggcaaatggtgttatattgcctgggcaggtctcgaaatcctgggctcaagctatcctcctgcctctgcctctgtaagagtgtgagccaccatgccccacccaaaccatttttcatatcagttatagcaaaacaagacaaaccagttcttaataatgttcaaagttggacccatagagacatgctaagcactacatcatgctaagaagaacagttattactcagctgccatacttcagccattctacttttacaccaagaacaaaatggctagagatttttttaaaaatacaaatgccagtaccttgccgagacttgttcactgatttgccccaaccccaaggtaatggtcatctactttgcaacctatggagatcctgatagctcccatacaaagtgaggtacactgttgccaatttggaggcaggaagccatcaaactaaacgtagtttaattcagatgaacacctatcgatattcaaaaggcaaaacaaaaaaactaattccagggacattagaccttggtgaaatgccaaatggaaaatggtgctttaaaaggtagtctcttaccatataaggaataagtaaaacattagcttgtgatttctcattattcaggtcaatgttttagacacgactaacaagggacagttcaaactattaaagagaacaaatttttacttaagcactttgaggtatccactccccttaaatgtaagttatgtattttatctgttgattaaggggaggtccaagcatttgtacttggcaggaatgctggcaatagcttgtgccagattactgtataaacttgaaagtaataaaaatgttctttaaaagtaaaaaaaaaaaa

SEQ ID NO: 319787 - DNA, 3911 bp, Homo sapiens
ctaggagcgaagcgtgcacgccttgtctttctccacctttcgtctttggtcacagcgccatctcatggttagctgaaactttgaaagaggattcattcttcagaggcaaggaatcggagtcctatgtctttctcgcgccttgaaggttacttagctaaagctaagatagcgagaaacagtacttttcaggtccttccatgatctacattcgtccttgttctcggaggacccagactctatggttaatgatgaagaggggcctctattcgttcagcgcttgcgcatgcgaggaggttccgcatgcgcggtggagtgagcgaagcgcacgctgaggaggatcggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaagttttaacttccagtggctggtttctgagagagtgccatgattgctagccagcattccatattgggaatatgtagaggagaacctggatgtacttaagagtggcatataattttcacttctgtctgttgaggcatcaaaaaaacaagtttagaaagctggcaacatgaagaatgcattcaaaatataacaggtgcttctttgttgtacgcagaggaattttttcttttgattttgtttactgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctcaaaaaaaaaaaaaaaaaccaaaaatcttgaatctcccatcaaagccttttcattaaaaatacaatttcatctactccctactgtacctttcactgatgtcaagtggctatcaattcatatagctgaaaattagtgatagtttgggtctcatttatgcataaattaattgaaaatcagtaatggccaggaagaaatatgaatattcaaaccacttttttctttttttttttttttttttggcaaatggtgttatattgcctgggcaggtctcgaaatcctgggctcaagctatcctcctgcctctgcctctgtaagagtgtgagccaccatgccccacccaaaccatttttcatatcagttatagcaaaacaagacaaaccagttcttaataatgttcaaagttggacccatagagacatgctaagcactacatcatgctaagaagaacagttattactcagctgccatacttcagccattctacttttacaccaagaacaaaatggctagagatttttttaaaaatacaaatgccagtaccttgccgagacttgttcactgattgcctaattgcctaaatgaagtgtacacaggaacagctatgca

SEQ ID NO: 319788 - DNA, 1797 bp, Homo sapiens
ctaggagcgaagcgtgcacgccttgtctttctccacctttcgtctttggtcacagcgccatctcatggttagctgaaactttgaaagaggattcattcttcagaggcaaggaatcggagtcctatgtctttctcgcgccttgaaggttacttagctaaagctaagatagcgagaaacagtacttttcaggtccttccatgatctacattcgtccttgttctcggaggacccagactctatggttaatgatgaagaggggcctctattcgttcagcgcttgcgcatgcgaggaggttccgcatgcgcggtggagtgagcgaagcgcacgctgaggaggatcggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatattta

SEQ ID NO: 319789 - DNA, 1710 bp, Homo sapiens
ctaggagcgaagcgtgcacgccttgtctttctccacctttcgtctttggtcacagcgccatctcatggttagctgaaactttgaaagaggattcattcttcagaggcaaggaatcggagtcctatgtctttctcgcgccttgaaggttacttagctaaagctaagatagcgagaaacagtacttttcaggtccttccatgatctacattcgtccttgttctcggaggacccagactctatggttaatgatgaagaggggcctctattcgttcagcgcttgcgcatgcgaggaggttccgcatgcgcggtggagtgagcgaagcgcacgctgaggaggatcggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagacgagatagcgtcgccgcgatggtgtcgttggagagcgagcagttcctgacggagctgaccagacttttccagaagtg

SEQ ID NO: 319790 - DNA, 1309 bp, Homo sapiens
ctaggagcgaagcgtgcacgccttgtctttctccacctttcgtctttggtcacagcgccatctcatggttagctgaaactttgaaagaggattcattcttcagaggcaaggaatcggagtcctatgtctttctcgcgccttgaaggttacttagctaaagctaagatagcgagaaacagtacttttcaggtccttccatgatctacattcgtccttgttctcggaggacccagactctatggttaatgatgaagaggggcctctattcgttcagcgcttgcgcatgcgaggaggttccgcatgcgcggtggagtgagcgaagcgcacgctgaggaggatcggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaagtggtcacagatacagatgagacgcatatcgggatcctctagatcacctcac

SEQ ID NO: 319791 - DNA, 933 bp, Homo sapiens
actcccagaaagtcgacgggcgtggcgggggaggggacgctgagggcccatgtgctgaaaatccgaagtgccgcggaaagtggaggtgagggccgcccgccctagaggtgcccgtccgagaggcagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgagtcc

SEQ ID NO: 319792 - DNA, 894 bp, Homo sapiens
actcccagaaagtcgacgggcgtggcgggggaggggacgctgagggcccatgtgctgaaaatccgaagtgccgcggaaagtggaggtagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgagtcc

SEQ ID NO: 319793 - DNA, 555 bp, Homo sapiens
actcccagaaagtcgacgggcgtggcgggggaggggacgctgagggcccatgtgctgaaaatccgaagtgccgcggaaagtggaggtcattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgagtcc

SEQ ID NO: 319794 - DNA, 790 bp, Homo sapiens
actcccagaaagtcgacgggcgtggcgggggaggggacgctgagggcccatgtgctgaaaatccgaagtgccgcggaaagtggaggtagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacagaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgagtcc

SEQ ID NO: 319795 - DNA, 297 bp, Homo sapiens
actcccagaaagtcgacgggcgtggcgggggaggggacgctgagggcccatgtgctgaaaatccgaagtgccgcggaaagtggaggtagctgacaaggaaggtttcgagcgttttgctggcaaagggatttcttacaacctccaggtggagatcctagaaggcaaggatgccgggaagcagggcaaagtggttcaagttatccggcagcgaaactgggtggtcgtgggagggctgaacacacattaccgctacatggcaagaccatggccatcggacgggcatggccatcgacggga

SEQ ID NO: 319796 - DNA, 991 bp, Homo sapiens
cttgtctgtaaaagggactttacgatgcatctggcaacctcaccttcctcactgggcaatgtgaagaccaaatgccggcaatgaaattcccagcattaggtttgtcatatagtagtcctctctaagcatttgttgaatactcacaggaacacttaggccagtcagcattaattgaaaataacagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgagtcc

SEQ ID NO: 319797 - DNA, 1021 bp, Homo sapiens
actcccagaaagtcgacgggcgtggcgggggaggggacgctgagggcccatgtgctgaaaatccgaagtgccgcggaaagtggaggtgagggccgcccgccctagaggtgcccgtccgagaggcagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgagtccaaaaaaaaaaaaaaaacccggcttttcgggggaaaagtaaggccggtcttctcccttttaaggaagcgccaaagggaatacggaaaaa

SEQ ID NO: 319798 - DNA, 848 bp, Homo sapiens
actcccagaaagtcgacgggcgtggcgggggaggggacgctgagggcccatgtgctgaaaatccgaagtgccgcggaaagtggaggtgagggccgcccgccctagaggtgcccgtccgagaggcagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcggatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgagtcc

SEQ ID NO: 319799 - DNA, 1494 bp, Homo sapiens
taggctgacctagaggacccgcgcgtgttgttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaaatagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaacaataaaaaaaa

SEQ ID NO: 319800 - DNA, 519 bp, Homo sapiens
  misc_feature (390)..(390): n is a, c, g, or t
  misc_feature (425)..(425): n is a, c, g, or t
ggtaccccaaaagtgcactcttctatatctactctcacatggcagtactgggtacacgttaggtattttacaaacgaaagaatcacttagcaaggttgaatggctcaagagctgacaaaagcagaatttacaaaggatgcatagtttcatgttgttcctgtgaatgttctctgtctaggttggtgaccagattgttgaaatcaatggggaacctacacaaggaatcacacatactcgagcaattgagctcattcaggctggtggaaataaagttcttcttcttttgaggccaggaactggcttgatacctgaccatggtaagtaaagtagcccactagtaatatagagggcacttttcaaaggcactcttctatatctacgaccgtacangcgagacctgatcagtttatatgcaaaatttagtntccctttataatgcttatcatatctcagagtcagtctatcatccaagaaaagtgtttaacctcttcggttgttcgtagatatagagaagccggc

SEQ ID NO: 319801 - DNA, 7161 bp, Homo sapiens
  misc_feature (507)..(507): n is a, c, g, or t
  misc_feature (619)..(619): n is a, c, g, or t
cgaattcccccctcccctccccataacatgcccactgccccaaataaaaaaaaaaccaactatgggagagcagccgagacagcaactaggggcaggggaaagagacatggaactcgagggcagcggtgaagagaccatgcgtgtgctgggagggcccagaggcagcggcggcacaaacagcgcaggtacgagtctctgtgtcttccccggggttatgtataaatatagagagatgaggccttctctcccctgctctcccttccgctccgtgctgctcgccgcggtcccagctcctctttccacatgagggcgaagggaaggggggatgaacaagtcatcaccgaattgcaatcagacccacatccatcagcttctggatcttctgtgctattacaggattctttaagtgttcgctgagtgcctgctcctggggacaattcccttttcctttcttcagcctaacccgcggtggccctcgcggagtccggtcagccccggggagcgcanccgggaggggcgtccaaggggcgtctcgcgtctgggaacggccgggcccccagcgggctgtggtcgcggggtgggggccggagcggcgaggccccccttaccgggctgcgcnggccgcccagggcccccgggctgagacggggccggagcggcgccccggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtttggctccttccggtctgtgctcctacgtgaaacccgagcaacattaaggctttcagggcttttcttggtctttccttaaaaagacttggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgcctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaaagcagcaaaaaattgaaggaagcaaagctccatcaaatgctgaggccaaattattagagggtaagagtcgaagaatagcaggctatacgggcagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaaatagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaacaataaaaaaaa

SEQ ID NO: 319802 - DNA, 4213 bp, Homo sapiens
  misc_feature (507)..(507): n is a, c, g, or t
  misc_feature (619)..(619): n is a, c, g, or t
cgaattcccccctcccctccccataacatgcccactgccccaaataaaaaaaaaaccaactatgggagagcagccgagacagcaactaggggcaggggaaagagacatggaactcgagggcagcggtgaagagaccatgcgtgtgctgggagggcccagaggcagcggcggcacaaacagcgcaggtacgagtctctgtgtcttccccggggttatgtataaatatagagagatgaggccttctctcccctgctctcccttccgctccgtgctgctcgccgcggtcccagctcctctttccacatgagggcgaagggaaggggggatgaacaagtcatcaccgaattgcaatcagacccacatccatcagcttctggatcttctgtgctattacaggattctttaagtgttcgctgagtgcctgctcctggggacaattcccttttcctttcttcagcctaacccgcggtggccctcgcggagtccggtcagccccggggagcgcanccgggaggggcgtccaaggggcgtctcgcgtctgggaacggccgggcccccagcgggctgtggtcgcggggtgggggccggagcggcgaggccccccttaccgggctgcgcnggccgcccagggcccccgggctgagacggggccggagcggcgccccggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtttggctccttccggtctgtgctcctacgtgaaacccgagcaacattaaggctttcagggcttttcttggtctttccttaaaaagacttggtaaatttgcatgtcttgtaaatcactttcttcttttgttttcttttaaattaaaaatgatgctattaaatacatctatttctat

SEQ ID NO: 319803 - DNA, 5743 bp, Homo sapiens
  misc_feature (507)..(507): n is a, c, g, or t
  misc_feature (619)..(619): n is a, c, g, or t
cgaattcccccctcccctccccataacatgcccactgccccaaataaaaaaaaaaccaactatgggagagcagccgagacagcaactaggggcaggggaaagagacatggaactcgagggcagcggtgaagagaccatgcgtgtgctgggagggcccagaggcagcggcggcacaaacagcgcaggtacgagtctctgtgtcttccccggggttatgtataaatatagagagatgaggccttctctcccctgctctcccttccgctccgtgctgctcgccgcggtcccagctcctctttccacatgagggcgaagggaaggggggatgaacaagtcatcaccgaattgcaatcagacccacatccatcagcttctggatcttctgtgctattacaggattctttaagtgttcgctgagtgcctgctcctggggacaattcccttttcctttcttcagcctaacccgcggtggccctcgcggagtccggtcagccccggggagcgcanccgggaggggcgtccaaggggcgtctcgcgtctgggaacggccgggcccccagcgggctgtggtcgcggggtgggggccggagcggcgaggccccccttaccgggctgcgcnggccgcccagggcccccgggctgagacggggccggagcggcgccccggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgcctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaaagcagcaaaaaattgaaggaagcaaagctccatcaaatgctgaggccaaattattagagggtaagagtcgaagaatagcaggctatacgggcagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaagg

SEQ ID NO: 319804 - DNA, 3441 bp, Homo sapiens
ggtaccccaaaagtgcactcttctatatctactctcacatggcagtactgggtacacgttaggtattttacaaacgaaagaatcacttagcaaggttgaatggctcaagagctgacaaaagcagaatttacaaaggatgcatagtttcatgttgttcctgtgaatgttctctgtctaggttggtgaccagattgttgaaatcaatggggaacctacacaaggaatcacacatactcgagcaattgagctcattcaggctggtggaaataaagttcttcttcttttgaggccaggaactggcttgatacctgaccatggtttggctccttccggtctgtgctcctacgtgaaacccgagcaacattaaggctttcagggcttttcttggtctttccttaaaaagacttggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgcctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaaagcagcaaaaaattgaaggaagcaaagctccatcaaatgctgaggccaaattattagagggtaagagtcgaagaatagcaggctatacgggcagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaaatagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaacaataaaaaaaa

SEQ ID NO: 319805 - DNA, 2519 bp, Homo sapiens
  misc_feature (50)..(50): n is a, c, g, or t
acagtaacctttagtataaaacaaaaaaaaacaagttgtaatcttttctnacagcagcatttttccaaaaaaagccttttttttttttcaaatattctgaaacagataagtacatgttaatgtgagcctcaagttacctaggctgcatgaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaaatagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaacaataaaaaaaa

SEQ ID NO: 319806 - DNA, 669 bp, Homo sapiens
tacaccctcagttttcccacctagaaaatggggctaataataaatgttagctcttaattattttcctttaaaatgctatcattttgcaaaactaggctaggtaagtagttcatatggaatacttttctgagagaaaggtattagcttgagagcaggaataaggtattttacaggcactctatacagcagtgcctgtacagatttaatgtaccttacccaagtgttaacttaggtcatttgcacctgtcaaatatcaaactcaagtttgatcattctgaattcaacattgttatattgattggacagcattagaagttaatggcagtgtaatactgagtatatggaagtgagagtaaatgtttctaaacagtcttcatacagttttgtttagagctcaaaacgaggatttatagttgaattgtgtgtgtgtgttacactcttgtgcaaattttccatattaaaaagttctgagattatagtttattgagttactctataatatcctactaaatactgaactttgttttgttttaatccttttaaaataaatcatagtatttatattttctgattttcctcagcaccaaacaccaaagatttggatgtttttcttcgaaaacaagagtcagggtttggcttcagggtgctaggaggagatggacctgacca

SEQ ID NO: 319807 - DNA, 293 bp, Homo sapiens
cacatagtcctaggctttttctcttccctcttcaggtttggctccttccggtctgtgctcctacgtgaaacccgagcaacattaaggctttcagggcttttcttggtctttccttaaaaagacttggtaaatttgcatgtcttgtaaatcactttcttcttttgttttcttttaaattaaaaatgatgctattaaatacatctatttctatcttctgcacttttcagtcttcttttgacattaaatttgacagcttaatgcaagagaattattacaaatgcccatgagcctca

SEQ ID NO: 319808 - DNA, 466 bp, Homo sapiens
ttcattttctcagttcagagagtgacttgatttctctctcttgtagaagtgccctagaaggtgaaattggaaaagatgtctccacttcttacagacattcttggtcagaccacaagcaccttgcacagcctgacaccgcagtaatttcagttgtaggcagtcggcacaatcaggtaaacaaacatttccccagatggggagtgatattttgagttgccataccactggcattggtgaatttttattgcaaatcagttcagataaatttgtttccaaaactaataattctcgaagacctgccatgtgtttggcattctgctggcattcataggagaatgttaggagtgaaagaaaagtttcccctacagcaggagagctttgaacccttggttaagtacttagaagtaaatagtattttagataatcaaattcaggtttttttgtttgttacttgtttgtttccagg

SEQ ID NO: 319809 - DNA, 4288 bp, Homo sapiens
  misc_feature (507)..(507): n is a, c, g, or t
  misc_feature (619)..(619): n is a, c, g, or t
cgaattcccccctcccctccccataacatgcccactgccccaaataaaaaaaaaaccaactatgggagagcagccgagacagcaactaggggcaggggaaagagacatggaactcgagggcagcggtgaagagaccatgcgtgtgctgggagggcccagaggcagcggcggcacaaacagcgcaggtacgagtctctgtgtcttccccggggttatgtataaatatagagagatgaggccttctctcccctgctctcccttccgctccgtgctgctcgccgcggtcccagctcctctttccacatgagggcgaagggaaggggggatgaacaagtcatcaccgaattgcaatcagacccacatccatcagcttctggatcttctgtgctattacaggattctttaagtgttcgctgagtgcctgctcctggggacaattcccttttcctttcttcagcctaacccgcggtggccctcgcggagtccggtcagccccggggagcgcanccgggaggggcgtccaaggggcgtctcgcgtctgggaacggccgggcccccagcgggctgtggtcgcggggtgggggccggagcggcgaggccccccttaccgggctgcgcnggccgcccagggcccccgggctgagacggggccggagcggcgccccggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatttcactcttgtcgcccaagctggagtgcaatggcatgatctcggctcactgcaacctccgcctcctgggttcaatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtttggctccttccggtctgtgctcctacgtgaaacccgagcaacattaaggctttcagggcttttcttggtctttccttaaaaagacttggtaaatttgcatgtcttgtaaatcactttcttcttttgttttcttttaaattaaaaatgatgctattaaatacatctatttctat

SEQ ID NO: 319810 - DNA, 7070 bp, Homo sapiens
  misc_feature (507)..(507): n is a, c, g, or t
  misc_feature (619)..(619): n is a, c, g, or t
cgaattcccccctcccctccccataacatgcccactgccccaaataaaaaaaaaaccaactatgggagagcagccgagacagcaactaggggcaggggaaagagacatggaactcgagggcagcggtgaagagaccatgcgtgtgctgggagggcccagaggcagcggcggcacaaacagcgcaggtacgagtctctgtgtcttccccggggttatgtataaatatagagagatgaggccttctctcccctgctctcccttccgctccgtgctgctcgccgcggtcccagctcctctttccacatgagggcgaagggaaggggggatgaacaagtcatcaccgaattgcaatcagacccacatccatcagcttctggatcttctgtgctattacaggattctttaagtgttcgctgagtgcctgctcctggggacaattcccttttcctttcttcagcctaacccgcggtggccctcgcggagtccggtcagccccggggagcgcanccgggaggggcgtccaaggggcgtctcgcgtctgggaacggccgggcccccagcgggctgtggtcgcggggtgggggccggagcggcgaggccccccttaccgggctgcgcnggccgcccagggcccccgggctgagacggggccggagcggcgccccggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggcaaagtcattaataaagatttgcggcattacctaagtcttcagtttcaaaaaggatcaattgaccacaaactgcagcaagtgatcagagataatctctacttgagaaccattccatgcactacaagggcccccagggatggagaagtaccaggagtggattataatttcatttccgttgaacagttcaaagcactggaagagagtggagcattgttagaaagtgggacatatgatggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgaccacaataccaagacaaccacctggttggatcctcgtctttgtaagaaagccaaagcccctgaagactgtgaagatggagagcttccttatggctgggagaaaatagaggaccctcagtatgggacatactatgttgatcaccttaaccagaaaacccagtttgaaaatccagtggaggaagccaaaaggaaaaagcagttaggacaggttgaaattgggtcttcaaaaccagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtcctccttcaccaaccaaaactgccaaaatgaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaaccaccaaacaccaaagatttggatgtttttcttcgaaaacaagagtcagggtttggcttcagggtgctaggaggagatggacctgaccagtctatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaagagcatcatggtccaccatcaggaacaaactcagccaggcaaagcccagccctgcagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgcctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaaagcagcaaaaaattgaaggaagcaaagctccatcaaatgctgaggccaaattattagagggtaagagtcgaagaatagcaggctatacgggcagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaaatagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaacaataaaaaaaa

SEQ ID NO: 319811 - DNA, 3599 bp, Homo sapiens
ccccgactagcccgacaggatactaatatccagaatttactaagaactcaacaacaaacaaacaaaacataacaaaaaaacaacaacaaaaaatctcattaacagtaagcacaggcccatgggacagtcacaggccaaccacatacctggggacagaagtgccctagaaggtgaaattggaaaagatgtctccacttcttacagacattcttggtcagaccacaagcaccttgcacagcctgacaccgcagtaatttcagttgtaggcagtcggcacaatcagaaccttggttgttatccagtagagctggagagaggcccccggggctttggattcagcctccgaggggggaaggagtacaacatggggctgttcatccttcgtcttgctgaagatggtcctgccatcaaagatggcagaattcatgttggtgaccagattgttgaaatcaatggggaacctacacaaggaatcacacatactcgagcaattgagctcattcaggctggtggaaataaagttcttcttcttttgaggccaggaactggcttgatacctgaccatggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgcctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaaagcagcaaaaaattgaaggaagcaaagctccatcaaatgctgaggccaaattattagagggtaagagtcgaagaatagcaggctatacgggcagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaaatagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaacaataaaaaaaa

SEQ ID NO: 319812 - DNA, 1831 bp, Homo sapiens
  misc_feature (507)..(507): n is a, c, g, or t
  misc_feature (619)..(619): n is a, c, g, or t
cgaattcccccctcccctccccataacatgcccactgccccaaataaaaaaaaaaccaactatgggagagcagccgagacagcaactaggggcaggggaaagagacatggaactcgagggcagcggtgaagagaccatgcgtgtgctgggagggcccagaggcagcggcggcacaaacagcgcaggtacgagtctctgtgtcttccccggggttatgtataaatatagagagatgaggccttctctcccctgctctcccttccgctccgtgctgctcgccgcggtcccagctcctctttccacatgagggcgaagggaaggggggatgaacaagtcatcaccgaattgcaatcagacccacatccatcagcttctggatcttctgtgctattacaggattctttaagtgttcgctgagtgcctgctcctggggacaattcccttttcctttcttcagcctaacccgcggtggccctcgcggagtccggtcagccccggggagcgcanccgggaggggcgtccaaggggcgtctcgcgtctgggaacggccgggcccccagcgggctgtggtcgcggggtgggggccggagcggcgaggccccccttaccgggctgcgcnggccgcccagggcccccgggctgagacggggccggagcggcgccccggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccagttcaaagctggagactggatactgacatgttcatgaccttgtgtacaagctgaaagctgctgaaagctacaggccaatggggctctgctttacttctgccttccatatcttgtgtcctgcatcttaatggtggaatcagatttgcatccagaatactagctataaaggagtctggaaaagacagtttttagttttccaacttctgcgtttcaggaaggcatactacaaggaggaagtcgctgagtgatagctgatcctttcccaggcactcatcttcttaaacatagtatattaattacaatttagcccattcttgatggctcattgtcatttctgtgagcttctcttttcataatggcctgtagttggaataatcatagggccaagggattttaacatctgtagtaactttttgtcctaggttagcttgtatctctcccacctcccataactgctgctgagacatctatgtttgatatcatttgacgtcaacctcccctgcaagccacaggcagggagagcacctcacccaaagcaaccagtttattggctggtcagcaacctgtgatttctgtagcttaaaaagatgagtggggcttattgtcttttgaactaagacaaaaaggaaagaatttccaattaagggtgggagcttcagctgagaggttttgaagtgagttggctgtattcttttgcaagaccaattgttaaattttcaagaattttgtgagttgtcaaacagccatttttaagaattaagttgcataataatttaataaaaacaaagataaatactcaaaaaaaat

SEQ ID NO: 319813 - DNA, 3052 bp, Homo sapiens
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacca

SEQ ID NO: 319814 - DNA, 1030 bp, Homo sapiens
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggccagaacttcaattgtgtccctaatgggaaaccttgctgggatcatgtggtctacagcacaaggttgctaaagcatcttctgccagaattctgtgagtatctggttaggtgggtctggaatatactgagtttaaaaaagttaaataggtttctttactgcaagatgtttcagagactttaatatgctactctgctgtatgaatctccaggcaggaaatcttataaaatgtgtttctgaaatg

SEQ ID NO: 319815 - DNA, 1349 bp, Homo sapiens
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggccagaacttcaattgtgtccctaatgggaaaccttgctgggatcatgtggtctacagcacaaggttgctaaagcatcttctgccagaattctgtgagtatctggttaggtgggtctggaatatactgagtttaaaaaagttaaataggtttctttactgcaagatgtttcagagactttaatatgctactctgctgtatgaatctccaggcaggaaatcttataaaatgtgtttctgaaatgacaaaaaaaaacaacacacaacagttttcaaaaaaaagaagaaaaacaatcagaagcacccgaccagacataccaaacgagccagaccaacacacgtgccgttggggccgcgcggcgccgcagaagaaagggtttttaacacaccgcgtgggagcagccgccacaaggatgacaaccaccgtgcctcactcgtggtccaacgaaagcccgcgggcaactcgcgcgtgggtaccccaaaaaaaaccgcgcggaacgccgtcttaaagccaggggcacgcccacaggcacgaagacgcagcgctaatccccgccggggggc

SEQ ID NO: 319816 - DNA, 2998 bp, Homo sapiens
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggcttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacca

SEQ ID NO: 319817 - DNA, 3592 bp, Homo sapiens
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccaaaaaaacagagcagaaagacgacacagttgacgcaacaaccaaacatagcaacgaggccactggagcactcacaaacaataatcaacgcgctacaggccgtcaacccggaacacaaatgaccaacctaaccacgcatcgacagggccgcgcccccttcaacatcgcatcatccctgagcggagcacaccgtggactctccggcgctcccccactacttccaccagcatcgtgaccgaactctataccgacgatgagtattacgtgatgggcccggcaccatagaaagccagaccaaggacagacagaaacaacaacgggtggcaggactggagagacaccgactgacccgggcggcgaaggagcgcgccggacaagcactgaggaacacagcggccacgatactacacaatggtgtgatcggcaaaaccccgcgagccgcgcgaaacggcgcggcgatgcatccagaattcgcggcccagagaaatggccgaaggcgccccgcgccacacgagcgcggcgcgagcggacgacacagccca

SEQ ID NO: 319818 - DNA, 3083 bp, Homo sapiens
  misc_feature (2826)..(2826): n is a, c, g, or t
  misc_feature (2831)..(2831): n is a, c, g, or t
  misc_feature (2839)..(2839): n is a, c, g, or t
  misc_feature (2903)..(2903): n is a, c, g, or t
  misc_feature (2912)..(2914): n is a, c, g, or t
  misc_feature (2940)..(2940): n is a, c, g, or t
  misc_feature (2949)..(2949): n is a, c, g, or t
  misc_feature (2952)..(2952): n is a, c, g, or t
  misc_feature (2975)..(2975): n is a, c, g, or t
  misc_feature (2977)..(2977): n is a, c, g, or t
  misc_feature (2980)..(2980): n is a, c, g, or t
  misc_feature (2984)..(2984): n is a, c, g, or t
  misc_feature (2996)..(2996): n is a, c, g, or t
  misc_feature (3000)..(3000): n is a, c, g, or t
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtcaacgtacgttgacacttcagctcctnctgcnaagcaacnaaggatgggagtacagggttgggagggtctggctgttgagaccctcaggtttgctcagactctnctgaccctnnnaggccacactcaccacgagtctgtgnaggaagggnaantttagtgcagctcccactgctcntnctntccngctgtccttccntctnttttggaataacgcctcatccttcagaactaacctgcagtgtccacagttctcctcgaccacctgaagtgtcacgtgagatcc

SEQ ID NO: 319819 - DNA, 2016 bp, Homo sapiens
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacgaaatttgcccgtgtgggcctggttttcaaaactaagttttgccggggaggcccggacgagccgggccgcagggtgtcagggcgccggcaaattacccggggaacgaaaaaaagggaagggggca

SEQ ID NO: 319820 - DNA, 2969 bp, Homo sapiens
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctggtggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacca

SEQ ID NO: 319821 - DNA, 2903 bp, Homo sapiens
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggctggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacca

SEQ ID NO: 319822 - DNA, 3027 bp, Homo sapiens
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaacaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacca

SEQ ID NO: 319823 - DNA, 2954 bp, Homo sapiens
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcactggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacca

SEQ ID NO: 319824 - DNA, 2961 bp, Homo sapiens
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacca

SEQ ID NO: 319825 - DNA, 1970 bp, Homo sapiens
accccaaacaagtgtccgtacagggcgccgactggactgagtacaggtaaagctcgagacaactggcttctatgatgctactgtatctgtcagtgagaatatctagcgaatctagaagctaagtagcacgggctcctacacaccaactcaaagggagggcaccaggtgcgaccagagaccgtcgtgaagatgatggagaccgcggatgtgctgagcgatcgatgtgtgtcatctcaatctaacgaaggaggtccatcgtcgaggctctgattatccagatgtaggactcgcaggcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacca

SEQ ID NO: 319826 - DNA, 2442 bp, Homo sapiens
cgagcagccaaggttcgccataatgactgctctcggtcgtgaggagaggagaagctcgcggcgcagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacca

SEQ ID NO: 319827 - DNA, 3081 bp, Homo sapiens
  misc_feature (3058)..(3058): n is a, c, g, or t
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccaaaaaancaaaaaacacaccaccaaacact

SEQ ID NO: 319828 - DNA, 3518 bp, Homo sapiens
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaaaaaaaaaaaaccttttggcccctttggcccaagtcaattttaaattggacaaagtttttccttggggccaaatttggggctaattggccaaattccccttatggggggccgtttaaaattaaatgggccgggttttaaaaacgtggaaattggaaaaaccttgggtttcccaaattaaatccctttgaaaaaaatccccttttcccaagttggggaattaccaaaagggcccgacccgttggcctttccaaaaattggccaaccttaatgggcaattggaattgtgaagcgtaaatttttggtaaaatttcggtaaaattttgtgaaaaacgccattttttaacccaatgggccaaaattgccctttttt

SEQ ID NO: 319829 - DNA, 2577 bp, Homo sapiens
agcgggggggcaggtgagccgcgggggccgagtgaggaccccgggcctcgggtcccaggcgcaagggtgcccggccgggcggggtcgggaccccagtgaggaggggccgggggctgccccgcgggcgcgtgacgcgtctcgggcctgcccggctgcgctggtctccgctcgggtgaggcggcttggcttcgcttttcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacca

SEQ ID NO: 319830 - DNA, 3028 bp, Homo sapiens
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacca

SEQ ID NO: 319831 - DNA, 2769 bp, Homo sapiens
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacca

SEQ ID NO: 319832 - DNA, 1626 bp, Homo sapiens
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgacactgacacggcctgagatcctggagatcacctcac

SEQ ID NO: 319833 - DNA, 2998 bp, Homo sapiens
taaacggagcgcatttttctcatttgttaatatcaccacctaaatcatctcttgcctaaaacaaggagtagaaagtgaatgaaggaaggaacaggtgatggtcagtgtcctttctacgcctcaaaatttaagagtttatgtgaaaattcataaatattaatctcaatccaggttaagcaaaattttttgctctcctctttagaaatttctggttgccaaagttccagaaattgcttcctcattcctgagcctttcattttctcgatttctccattatgtaacggggagctggagctttgggccgaatttccaattaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacgtgctgggaagtgccatgagcaggcccatcatacatttcggcagtgactatgaggaccgttactatcgtggcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacca

SEQ ID NO: 319834 - DNA, 238 bp, Homo sapiens
cgtaccatcaatctagcaccaaaaacagaaacctgagagacaaaatcaattccttctgttttatacccccctccacgtatcacccaatccttttaaatttatctccaaaataccctgaaatcatttatatctctcatctctacaacaccatcttagtccaaggtgccattatttcttggcaaaatactgtgatgactagctgactgaatggatacacacacacacacacacacacaca

SEQ ID NO: 319835 - DNA, 509 bp, Homo sapiens
cggacgcgtgggtgaccccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 319836 - DNA, 859 bp, Homo sapiens
  misc_feature (50)..(50): n is a, c, g, or t
  misc_feature (96)..(96): n is a, c, g, or t
  misc_feature (106)..(106): n is a, c, g, or t
  misc_feature (117)..(117): n is a, c, g, or t
  misc_feature (120)..(120): n is a, c, g, or t
  misc_feature (160)..(160): n is a, c, g, or t
  misc_feature (172)..(172): n is a, c, g, or t
  misc_feature (241)..(241): n is a, c, g, or t
  misc_feature (245)..(245): n is a, c, g, or t
  misc_feature (280)..(280): n is a, c, g, or t
  misc_feature (291)..(291): n is a, c, g, or t
  misc_feature (295)..(296): n is a, c, g, or t
  misc_feature (303)..(303): n is a, c, g, or t
  misc_feature (315)..(315): n is a, c, g, or t
  misc_feature (343)..(343): n is a, c, g, or t
  misc_feature (347)..(347): n is a, c, g, or t
  misc_feature (371)..(371): n is a, c, g, or t
acatcgagtgccaaggggactccagtatggcatcgcatgacagacagcanccccgaaacaaagtattttacccccaaatatattctttagcatatnttgaaatggncctgcaaagcngcntcttgtgggggaaattacattctatagaggattcccttcnctttgatttcanacattttagggagacacaagacatcaagcgatatatgtgaggtatgcactggttcagtctggaaaggangganaactcaaagctgaagtttgggggtggtggccttanaggtcacaagngganncaaagantttctgattggnaactagttgaaagagtttatctaaaggnctgnagtcaatagaaagaggtgtctggntatgattccgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 319837 - DNA, 932 bp, Homo sapiens
cggacgcgttgggcggacgcgtgggcgccgcgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaaaaaacaaaaaacccggggttttttttgggggggggaaaaaggggtttggaatgggcctggtgcatagggtttcggacccgttttttggtcaagggggaaatcggggggaccccccaaaagggaggcgaataaattcgaataagccggttaaccgggtaaacgcgcgggaaagcccgcgggatattacccggctaatgaaggggctaatttgtgacaccaagacctcctttgaaaaccatccacgggaggaaccgcgggtcacacaagaatccgcgctacagggggtgtagctgcgcggcaccgaggctcaactctttcacggatagcggctgcagcgcatcacaaactgctagtacggagagggccatctaactgtccaggatatacgcgacaggcacggcg

SEQ ID NO: 319838 - DNA, 668 bp, Homo sapiens
cggacgcgtgggtgaccccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaatcattatttctttctcttcctcctctctttccctcttcttcttctctttcccacccctaattaatgggccgtctttaaacacgcggcatgggaaatccctgggcttccccaacttatcaccttggatctctacccttttccccaggtgggcct

SEQ ID NO: 319839 - DNA, 703 bp, Homo sapiens
  misc_feature (686)..(686): n is a, c, g, or t
  misc_feature (692)..(692): n is a, c, g, or t
  misc_feature (694)..(694): n is a, c, g, or t
aagcggaaaataccggcatgcgtgcggatgaggcctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagtacgtgtatcagtctcaatactgtgggttcttgcaaccggaacaaaactgccacccaagggaagaaggcatggagttcatggtgttagcgcaaaagttctgaatggcatccgtcctaccggaaacctaggaaaaggcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacattctatgcattcnatgtgncngtaccggct

SEQ ID NO: 319840 - DNA, 686 bp, Homo sapiens
tcccccgggctgcaggcgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagtacgtgtatcagtctcaatactgtgggttcttgcaaccggaacaaaactgccacccaagggaagaaggcatggagttcatggtgttagcgcaaaagttctgaatggcatccgtcctaccggaaacctaggaaaaggcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaagtcgacgcggccgcgaatttagtagtagtaggc

SEQ ID NO: 319841 - DNA, 673 bp, Homo sapiens
aagcggaaaataccggcatgcgtgcggatgaggcctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagtacgtgtatcagtctcaatactgtgggttcttgcaaccggaacaaaactgccacccaagggaagaaggcatggagttcatggtgttagcgcaaaagttctgaatggcatccgtcctaccggaaacctaggaaaaggcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 319842 - DNA, 537 bp, Homo sapiens
aagcggaaaataccggcatgcgtgcggatgaggcctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 319843 - DNA, 411 bp, Homo sapiens
  misc_feature (21)..(21): n is a, c, g, or t
ggccgcactgagaaaatgaanagctgatgcatactgcctcgtgccgaacggcactgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 319844 - DNA, 145 bp, Homo sapiens
aaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 319845 - DNA, 285 bp, Homo sapiens
  misc_feature (9)..(11): n is a, c, g, or t
ttcagacannncagcctttattttagaaaataattctgtagcttccactttctttcatgaaactgaggtcaggcaagaaacaaaaatccaccaagtcctctccatcctgccatggcgtcctggcctgtgaggacatggggcgcctgggagcgggcggggaggctgggcagcactgggccagagggtccgtagtagttaaggactatggcaaggagtctcaggccaaggatgtcattgaagagtatttcaaatgcaagaaatgaagaaataaatctttggctcaca

SEQ ID NO: 319846 - DNA, 515 bp, Homo sapiens
cggacgcgttgggcggacgcgtgggcgccgcgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 319847 - DNA, 891 bp, Homo sapiens
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaaaaaaaaaaaaaaaaaaaaaaaaaaaaacaaaaaaaaaacaaaaaaaaaaaaaaaaaaaaaaaaaaaaaaaaaaaaaaaaaattaatttaatcataatcatatttaaaaactctataaaaaaaattattatatatttatttactatacaaatttcctcaattttgcgtttatttataatccgcccg

SEQ ID NO: 319848 - DNA, 721 bp, Homo sapiens
  misc_feature (704)..(704): n is a, c, g, or t
  misc_feature (710)..(710): n is a, c, g, or t
  misc_feature (712)..(712): n is a, c, g, or t
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacattctatgcattcnatgtgncngtaccggct

SEQ ID NO: 319849 - DNA, 888 bp, Homo sapiens
  misc_feature (733)..(733): n is a, c, g, or t
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaacaaaaaaaaaaaaaaaaaaaaaaaccncggggggttttttatggggggggggggaaaagggggagaaaaaagggcgccgggcacaagaggaccggggcccagtttccggacaccacggggaaacatcagaggagccccataggaggcgggacataatcgcgaaagcccggtacccggataag

SEQ ID NO: 319850 - DNA, 1461 bp, Homo sapiens
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaacaaaaaaaaaaaaaaaaaaaaaaaaaaaaaaaaaaaaaaaaaaaaaaaaaaaaaaaaacaaaaaaaaaacaaaaaaaaaaaaaaaaaaaaaaaaaaaaaaaaaaaaaaaaaaaaaaaaacacaaaaaaaaaaaagcagggggggggggaaaggacccagggcggggggggcaaaaaccaagaagccacccgggagaggagcgagcggcgagacagggcgggcagaggaacaaggacgaggccgcagcaggcgcacgggagaacgcagcggaaccaacccagcgagcccaaggaggcaacagggacgaacgaagatgggggcacagcacgacgcaaggaaggaggagcgggcgagacggagaacacggaggggtccagcgccgaggacaaggagggcggaacgcacggaagagagacagggggagcggcggggcgaaaggagcggagcagaaagcgggccgggggggggagggaagccggggacgacatgcggggcggcggccgcgccacgcgggagagagagagggggagcagggccgacgaacaagggagtcgccgacgaacgagcgcggcaccggggcggcgacaagcacaccggagcagccgaggcggcggagagaggataggggaggggacagggaaagggcgagcaggcaaccgaccaacgacgaaggcaccaagcagagccggggcaaggaggaaggagaggcggggggagaagcgacgcggggggagcggcgagggaagcaggcaaca

SEQ ID NO: 319851 - DNA, 1026 bp, Homo sapiens
  misc_feature (715)..(715): n is a, c, g, or t
  misc_feature (719)..(719): n is a, c, g, or t
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaaaaaaaaacnaaanaaaagagggtataccttttagagcgttttaaagacgtagatgtttattggatgtgtgggacgagcacagatgtcgcgggggtatattattaaagaaagtccaccatttgaaagataggggagtggagaccattatatgccggcgagaggtagcttcatgcaaaaagatttatcagagagtaaaccgctcttaaataggggcaaaaagtggcgccttatacccatagagggggctctaagatatgtggggcctaatagatgtgtgccttaataatagttagctaagttgctgtgttctacaggtatag

SEQ ID NO: 319852 - DNA, 1021 bp, Homo sapiens
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaacaaaaaaaaaaaaaaaaaaaaaaaaaaaaaaaaaaaaaaaaaacaacaccggggggacatatgggggggggggcacaagcgtgacaaaagggccaggcgcaccaagaggacgagaccccacttaggcacacagcgggggaaaccgaggagcgccccaaaaagagagcggaacaaattagagaaacccgaggcacctataatttcctctgcagcacatacaaaaaaaaaaaggaggtaagagggggagtaacaatgggtaaaaagaagggataaaaagaaataatatattagaaataaattatatagtaaatcaaaagaagt

SEQ ID NO: 319853 - DNA, 899 bp, Homo sapiens
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaacaaaaaaaaaaaaaaaaaaaaaaaaaaaaaaaaaaaaaaaaaacacggggggccaatcatattggggggggggggaaaaagagggtatttaaaatgggcattgtggtccataagttgttttctttaggccccttttttttggacaaaggggggggaatagggggggccccatagaggaggggcataaatttcggaagct

SEQ ID NO: 319854 - DNA, 734 bp, Homo sapiens
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaagtcgacgcggccgcgaatttagtagtagtaggc

SEQ ID NO: 319855 - DNA, 1637 bp, Homo sapiens
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaacaaaaaaacaccacgcaacaacaaattttttggtgacgcgcctgttgcgacgagagaaaagaagtttattaaaaaccactttggtgttgtggggggggcgcggccccccccgatagtgtaattgcacaacccttggtctcacaggcgtgttccctcaaggaagaaccccgtggctccagcaacaaacagaggggcgggcttcttccccccccaataaaaaaaagcccggggggggaacacacgaagtcgtttttttgacaccaacaccccagagggtggggatctccgggacagccacaaaaaggggggctcaacataacacaagggaggggggccccagcaggaaggaggcagagattaattaaaaaattacccccccggcacgtaggtagagaacacacaaaacagcaagaagcagcacagaaacaaagagcagagttcatactgatagaacaccaagtacgaaagaagataacagtaacaagaccagagagcagcagggcagcaacctagctagtatagatctcgaccgcaggagtaacagcgagtcagtcacaatcaacacagcaagacagcaatacatcagctaaccacaaaacactaaactaaaactactatctgaccggagggaggcacaggagcgagagaagtgagaaggagacatagagagagagaagcagactgttgcgagctgagacgtaccgacagcgagaacggacgagctgagtgcagactagacatagacttgggaacgcatatagaagggaggacgacctaaacatactcaacgatagggacggagaggacggagaggcagccaagcgaagaacaagaaagaaatgagcgagagagaacagaagcgggactacactgatagggacgaagagacaagagagaaacacaatgaggatgccacgagagtagattcccacgcgcca

SEQ ID NO: 319856 - DNA, 711 bp, Homo sapiens
  misc_feature (687)..(687): n is a, c, g, or t
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcttcatttcttgcatttgaagtcgacgggccgcnaatttagtagtagtaggcggccgc

SEQ ID NO: 319857 - DNA, 688 bp, Homo sapiens
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaattaagatacgaattttagggcgc

SEQ ID NO: 319858 - DNA, 828 bp, Homo sapiens
cggacgcgttgggcggacgcgtgggcgccgcgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaaaaaacaaaaaaaacaaaaaaaaaaaaaaaaaaaggggggggggggcaaaaaaacccccggggggggggacagatgttatggagacacccagatgttgctttgaacgaggcggccgcatatagggaggtattataaaggagagagggggcgcgtataaacaggcgcgatgggaaaaagctctgggggatttttgaaggagcccatactgggggggggaaaaggggcaaactaccgagaatagaggcgggaataaactggggtagggtagccgggcatttgcggaaatgccggtttgaat

SEQ ID NO: 319859 - DNA, 1109 bp, Homo sapiens
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggtaagtcaccgtttattctagggatgaaggttatgctgggtaatcatataaaaccttgtattgaaataagttgaggatcttataaaaggaaaaaactgattcaacaggtttaaagcattttctgcatttcaggaaaaaaataaaagctgtaatttacaagccagccaatgaatctgcttacctgattgtgtttgtgcagacatactttaaaaactggcaatagtaaagccatgttacgagccttaaggacattgaagtcgttaaggtccctgagaatggctataacaaatcttagtgatgggaaacatttttataagacatagctaattgttgaagctccactataattgatactaatagcttggtgaaattcctaaatattaacaagaaattgcatgcgtgttttgttttttttaaggactatggcaaggagtctcaggccaaggatgtcattgaagagtatttcaaatgcaagaaatgaagaaataaatctttggctcaca

SEQ ID NO: 319860 - DNA, 2090 bp, Homo sapiens
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctacaaaagaagcataaaagtatgttgtgtattactgacagttctagattaatttcttttagaattaaagtagatttgttaaagtgtattgtgtgttgtaaattttttgagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaactctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagtacgtgtatcagtctcaatactgtgggttcttgcaaccggaacaaaactgccacccaagggaagaaggcatggagttcatggtgttagcgcaaaagttctgaatggcatccgtcctaccggaaacctaggaaaaggcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 319861 - DNA, 653 bp, Homo sapiens
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaagagggtgtgttccatttgtaaaaattaaggctcttggcggggggtcagcccggggtgattttagagattttgcgcgtg

SEQ ID NO: 319862 - DNA, 1934 bp, Homo sapiens
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctacaaaagaagcataaaagtatgttgtgtattactgacagttctagattaatttcttttagaattaaagtagatttgttaaagtgtattgtgtgttgtaaattttttgagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaactctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaaggcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 319863 - DNA, 1954 bp, Homo sapiens
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctacaaaagaagcataaaagtatgttgtgtattactgacagttctagattaatttcttttagaattaaagtagatttgttaaagtgtattgtgtgttgtaaattttttgagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaactctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 319864 - DNA, 2133 bp, Homo sapiens
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctacaaaagaagcataaaagtatgttgtgtattactgacagttctagattaatttcttttagaattaaagtagatttgttaaagtgtattgtgtgttgtaaattttttgagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaactctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagtacgtgtatcagtctcaatactgtgggttcttgcaaccggaacaaaactgccacccaagggaagaaggcatggagttcatggtgttagcgcaaaagttctgaatggcatccgtcctaccggaaacctaggaaaaggcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaagtcgacgcggccgcgaatttagtagtagtaggc

SEQ ID NO: 319865 - DNA, 2153 bp, Homo sapiens
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctacaaaagaagcataaaagtatgttgtgtattactgacagttctagattaatttcttttagaattaaagtagatttgttaaagtgtattgtgtgttgtaaattttttgagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaactctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaaggcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcagcttcgcgaattccacgtgctaggccaaggtcagggacacagatggtgccacccggtgcaggtctctccgctcatcaagctcggccgctactccgccctgttccctcggggtggcctaacggagccacgcgctagaattacctaaaagctcgggcagaagagggagaggaggataggagcagaaagagaaagaagaaagcaggatgaactgaaggggatcgccagagagttggcagaagatgacagcatataaagtgagtgacctggaccatcttggacagcagcggatgatag

SEQ ID NO: 319866 - DNA, 2096 bp, Homo sapiens
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctacaaaagaagcataaaagtatgttgtgtattactgacagttctagattaatttcttttagaattaaagtagatttgttaaagtgtattgtgtgttgtaaattttttgagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaactctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagtacgtgtatcagtctcaatactgtgggttcttgcaaccggaacaaaactgccacccaagggaagaaggcatggagttcatggtgttagcgcaaaagttctgaatggcatccgtcctaccggaaacctaggaaaaggcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggtgtatggcaagaagccaccccattcctccccacactcatcgcccttaccacgctactcctacctatctccccttttatattaataatctt

SEQ ID NO: 319867 - DNA, 1968 bp, Homo sapiens
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctacaaaagaagcataaaagtatgttgtgtattactgacagttctagattaatttcttttagaattaaagtagatttgttaaagtgtattgtgtgttgtaaattttttgagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaactctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagtacgtgtatcagtctcaatactgtgggttcttgcaaccggaacaaaactgccacccaagggaagaaggcatggagttcatggtgttagcgcaaaagttctgaatggcatccgtcctaccggaaacctaggaaaaggtatcagaactcagatctataaagcccacttaaaatgtgtgggttgctgtttggaatggggataagcactcaaaactacagtgtttgaatgatgactttaattgtcggatacccttcactccttttatgagtgaaacataagagtctgacaaacctgtaggttgtgga

SEQ ID NO: 319868 - DNA, 1820 bp, Homo sapiens
  misc_feature (1779)..(1779): n is a, c, g, or t
  misc_feature (1783)..(1786): n is a, c, g, or t
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctacaaaagaagcataaaagtatgttgtgtattactgacagttctagattaatttcttttagaattaaagtagatttgttaaagtgtattgtgtgttgtaaattttttgagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaactctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaaggcttgcatccaactgtgatgagcctatgtatgtcaagttggtggaggccctttgtgctgaacaccaaatcaacctaattaaggttgatgacaacaagaaactaggagaatgggnaggnnnnggtagcccgaagctgtgagggtcctctagacacc

SEQ ID NO: 319869 - DNA, 1881 bp, Homo sapiens
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctacaaaagaagcataaaagtatgttgtgtattactgacagttctagattaatttcttttagaattaaagtagatttgttaaagtgtattgtgtgttgtaaattttttgagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaactctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaaggcttgcatccaactgtgatgagcctatgtatgtcaagttggtggaggccctttgtgctgaacaccaaatcaacctaattaaggttgatgacaacaagaaactaggagaatgggtagggcgctcgttacggaggcgctcgttacggagggcgtcgttacggaggcgctcgttacggaggcgctcgttacggagggtgtaaggaggcgtcgttacgga

SEQ ID NO: 319870 - DNA, 1954 bp, Homo sapiens; identical to SEQ ID NO: 319863

SEQ ID NO: 319871 - DNA, 476 bp, Homo sapiens
caacccccccaacacacccatacgcagtggagccggggttaatcggacgaggcgcatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 319872 - DNA, 839 bp, Homo sapiens
gcgtccctactactactaaattcgcggccgtcgaccttagacaagcgccaacccatcttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaacaaaaaaaaaaaaaaaaaaaaaaaaaaaaaaaaaacaaaaaaaaaaaaaaacaaaaaaaaagggggggggggccaaaaaaaaccccagggggggccaaaagaaagaggcacgagaccaccaagattcagctccagtcagaagggggcggccaaaagaaggggcggagggaagaaaaagaagaagatggccggaaggcggccagtagataacaatcaaggctgatcctgcgagagagaaacaaaaccggaagaggggggagaaccacggtagagaagacgaaagccgaaccaccgcgtgagggggaggacgacaaaaagaacagcggcaacaaacacaacaccgaacgaaaagtacaaaacacaccacagagggagaaaaacaaacacaggccaacggcgcagcacagaaaggaagagcaacaacaagaggcaacggcagagagccacaagaagacgcgctgatgaccacggaagaaagcagaagaagacaaatattcaacaacga

SEQ ID NO: 319873 - DNA, 265 bp, Homo sapiens
  misc_feature (4)..(4): n is a, c, g, or t
  misc_feature (6)..(6): n is a, c, g, or t
cgcngnccgcgcgaacgctgcgagagacgacagaagggggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 319874 - DNA, 710 bp, Homo sapiens
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaatggacgtctatgcaagaatggacgtctatgcgagaatggacgtct

SEQ ID NO: 319875 - DNA, 693 bp, Homo sapiens
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatcgcaaggagccacactatgagccacccaaagtgccccacgatgcgccacaccatgagccacccaaggagccacacgacgag

SEQ ID NO: 319876 - DNA, 2349 bp, Homo sapiens
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctacaaaagaagcataaaagtatgttgtgtattactgacagttctagattaatttcttttagaattaaagtagatttgttaaagtgtattgtgtgttgtaaattttttgagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaactctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggtaaggctgctaaggattgtgttgggactaatgttcagtgatgcttgtatatgggggtaaattctgtgaagtctcaagctgttcattttgtgcaggtgtaaacattacgtgcacctgatactgtcggccattttaaagatgattgtaggtagaagcattttatacctgcagaattgaatcctaattttgacgttggtatacaacaaagattagtagcaggcttgtaggtgatcttagtgctgtacatgatgacaactggctccctctactgaactgccatgaggaaactgccatgtcacccttctgattacagccaccttttgggtttcatttaattttggtagtgttaatgtctattaatgtgatttttttttttttaacctttctcccaataggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 319877 - DNA, 2120 bp, Homo sapiens
  misc_feature (2103)..(2103): n is a, c, g, or t
  misc_feature (2109)..(2109): n is a, c, g, or t
  misc_feature (2111)..(2111): n is a, c, g, or t
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctacaaaagaagcataaaagtatgttgtgtattactgacagttctagattaatttcttttagaattaaagtagatttgttaaagtgtattgtgtgttgtaaattttttgagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaactctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagtacgtgtatcagtctcaatactgtgggttcttgcaaccggaacaaaactgccacccaagggaagaaggcatggagttcatggtgttagcgcaaaagttctgaatggcatccgtcctaccggaaacctaggaaaaggcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacattctatgcattcnatgtgncngtaccggct

SEQ ID NO: 319878 - DNA, 2767 bp, Homo sapiens
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctacaaaagaagcataaaagtatgttgtgtattactgacagttctagattaatttcttttagaattaaagtagatttgttaaagtgtattgtgtgttgtaaattttttgagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaactctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggtaaggctgctaaggattgtgttgggactaatgttcagtgatgcttgtatatgggggtaaattctgtgaagtctcaagctgttcattttgtgcaggtgtaaacattacgtgcacctgatactgtcggccattttaaagatgattgtaggtagaagcattttatacctgcagaattgaatcctaattttgacgttggtatacaacaaagattagtagcaggcttgtaggtgatcttagtgctgtacatgatgacaactggctccctctactgaactgccatgaggaaactgccatgtcacccttctgattacagccaccttttgggtttcatttaattttggtagtgttaatgtctattaatgtgatttttttttttttaacctttctcccaataggttgatgacaacaagaaactaggagaatgggtaggcctttgtaaaattgacagagaggggaaaccccgtaaagtggttggttgcagttgtgtagtagttaaggtaagtcaccgtttattctagggatgaaggttatgctgggtaatcatataaaaccttgtattgaaataagttgaggatcttataaaaggaaaaaactgattcaacaggtttaaagcattttctgcatttcaggaaaaaaataaaagctgtaatttacaagccagccaatgaatctgcttacctgattgtgtttgtgcagacatactttaaaaactggcaatagtaaagccatgttacgagccttaaggacattgaagtcgttaaggtccctgagaatggctataacaaatcttagtgatgggaaacatttttataagacatagctaattgttgaagctccactataattgatactaatagcttggtgaaattcctaaatattaacaagaaattgcatgcgtgttttgttttttttaaggactatggcaaggagtctcaggccaaggatgtcattgaagagtatttcaaatgcaagaaatgaagaaataaatctttggctcaca

SEQ ID NO: 319879 - DNA, 1914 bp, Homo sapiens
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctacaaaagaagcataaaagtatgttgtgtattactgacagttctagattaatttcttttagaattaaagtagatttgttaaagtgtattgtgtgttgtaaattttttgagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaactctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatcgcaaggagccacactatgagccacccaaagtgccccacgatgcgccacaccatgagccacccaaggagccacacgacgag

SEQ ID NO: 319880 - DNA, 1888 bp, Homo sapiens
  misc_feature (1831)..(1833): n is a, c, g, or t
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctacaaaagaagcataaaagtatgttgtgtattactgacagttctagattaatttcttttagaattaaagtagatttgttaaagtgtattgtgtgttgtaaattttttgagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaactctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaaggcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttgattgnnngttgtgtagtagtaaggactatggcaggagtgctgacgcttggtaccgagctcga

SEQ ID NO: 319881 - DNA, 2029 bp, Homo sapiens
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctacaaaagaagcataaaagtatgttgtgtattactgacagttctagattaatttcttttagaattaaagtagatttgttaaagtgtattgtgtgttgtaaattttttgagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaactctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttgggcgccgatgaatagcgcctcgctactcatcggcacctctgatagcaacaaatggcatctggcacgtggagggaacttgcattcttcaaccaatcttctctaacacgcggtgccgatgaatagcgaggtgccgatgaaagcgaggtgccgatgaatagcgagtgccgagaatagggcccgagc

SEQ ID NO: 319882 - DNA, 1775 bp, Homo sapiens
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctacaaaagaagcataaaagtatgttgtgtattactgacagttctagattaatttcttttagaattaaagtagatttgttaaagtgtattgtgtgttgtaaattttttgagtgaaatttgcttgcgctctgccttgccatttctttccagtaagtataattttgaaaaaattagaatatatgccaaatattgagtgctgtgactcttcctcataagagatgtgccagattctatgtctaattgcatattctcttcagaggagatgatgcttattttaaacctttttctctataacttttaaaaagtggtgctgagtattcactagagtggcaagtctttgtgctttaatgcactcaatttgtggaaattacttaaatagcaggttatcagatggttctgaatgacaaaggtgttaaatttgggatttttttttcaagctttagatatggctggagagtaatgagacagaaggaatgtcttatattgttctgactgctgacaattcctaaagaaaagtgatagaagggtttttaacaaaactctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaaggcttgcatccaactgtgatgagcctatgtatgtcaagttggtggaggcccggtgtgaagaacaccccaggtaaaaaactaagctcgatgaaaacagagctcccgaggaga

SEQ ID NO: 319883 - DNA, 899 bp, Homo sapiens
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaacaaaaaaaaaaaaaaaaaaaaaaaaaaccgggggggttttatggggggggcgggaacaacagagtgcataggaacggcggcccagtggtgcctaaagctggttcccgtggccccagttttctttggcacccaggggggaaactcggcggggccccctaaaggggggcgcggaataaattccaaaaacccgtgtcacccggtaagag

SEQ ID NO: 319884 - DNA, 850 bp, Homo sapiens
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaatcattatttctttctcttcctcctctctttccctcttcttcttctctttcccacccctaattaatgggccgtctttaaacacgcggcatgggaaatccctgggcttccccaacttatcaccttggatctctacccttttccccaggtgggcct

SEQ ID NO: 319885 - DNA, 874 bp, Homo sapiens
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaacaaaaaaaaaaaaaaaccaattcccctatagggaagtcgtttacaataactggcccgcgttttacaactccggactgggactctgctttaccccaataatcgcttggagtcccctttccagtggggtattacgagaggccgacccattcgcttccaacatgggcgctg

SEQ ID NO: 319886 - DNA, 985 bp, Homo sapiens
  misc_feature (985)..(985): n is a, c, g, or t
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaaaaaaaaaaaaaaagggggggggggcaaaaaatttccgtgggggggccccaactatactacgcgcacccaccagctttttggagacaaaggggcccccataaaggagacccagaaacaaagagacgacggggggcgcggtacaaaacgggccgggcgcgggaaacaacggcacctggaggatctgggcgaagcaccaacttctgggggcggacacttgggagcaccccacaagagagtatacgccccaggagacacaacagtcccgtctcacgcggaacn

SEQ ID NO: 319887 - DNA, 1004 bp, Homo sapiens
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaaaaaacaaaaaaaacaaaaaaaaaaaaaaaaaaaggggggggggggcaaaaaaacccccggggggggggacagatgttatggagacacccagatgttgctttgaacgaggcggccgcatatagggaggtattataaaggagagagggggcgcgtataaacaggcgcgatgggaaaaagctctgggggatttttgaaggagcccatactgggggggggaaaaggggcaaactaccgagaatagaggcgggaataaactggggtagggtagccgggcatttgcggaaatgccggtttgaat

SEQ ID NO: 319888 - DNA, 691 bp, Homo sapiens
actactactttcttttgtgcacggcctacaaatatgattttaccacttatttcttttccagtcatctcttccacagccttattggcatcctcgtgtttttcgtaactcacaaagccaaagcctttggatttcccattgggatctctcatcaccttgacacttagggtcttaccaaactgactgaatagctctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 319889 - DNA, 540 bp, Homo sapiens
  misc_feature (4)..(4): n is a, c, g, or t
  misc_feature (6)..(6): n is a, c, g, or t
cgcngnccgcgcgaacgctgcgagagacgacagaagggtctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 319890 - DNA, 4084 bp, Homo sapiens
ctgcaggttattcagcgatagttatgacctcccggttacgtgcgttgggtggaagaattaataatatacgcacctcggagttacccaaagagaaaactcgatcagaagtcatttgcagcatccactttttagatggcgtggtacagacctttaaagttactaaacaagacactggccaggttcttctggatatggtgcacaaccacctgggtgtgactgaaaaggaatattttggtttacagcatgatgacgactccgtggactctcctagatggctggaagcaagcaaacccatcaggaagcagttaaaaggaggtttcccctgtaccctgcattttcgagtaagattttttatacctgatcccaacacactgcagcaagaacaaaccaggcacttgtatttcttacaactgaagatggatatttgcgaaggaaggttaacctgccctcttaactcagcagtggttctagcgtcctatgccgtacaatctcattttggagactataattcttccatacatcatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtcggtaaataaccaatattgcaaaaaggtgattggcgggatggtgtggaacccagccatgcggagatccttatcagtggagcacttagaaaccaagagtctgccttctcgttcccctcccattactcccaactggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacattta

SEQ ID NO: 319891 - DNA, 4184 bp, Homo sapiens
ctgcaggttattcagcgatagttatgacctcccggttacgtgcgttgggtggaagaattaataatatacgcacctcggagttacccaaagagaaaactcgatcagaagtcatttgcagcatccactttttagatggcgtggtacagacctttaaagttactaaacaagacactggccaggttcttctggatatggtgcacaaccacctgggtgtgactgaaaaggaatattttggtttacagcatgatgacgactccgtggactctcctagatggctggaagcaagcaaacccatcaggaagcagttaaaaggaggtttcccctgtaccctgcattttcgagtaagattttttatacctgatcccaacacactgcagcaagaacaaaccaggcacttgtatttcttacaactgaagatggatatttgcgaaggaaggttaacctgccctcttaactcagcagtggttctagcgtcctatgccgtacaatctcattttggagactataattcttccatacatcatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtcggtaaataaccaatattgcaaaaaggtgattggcgggatggtgtggaacccagccatgcggagatccttatcagtggagcacttagaaaccaagagtctgccttctcgttcccctcccattactcccaactggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacatttaatgtggtatttttgaacagcggtttttatgtactcagaagaggaagtaaagccaggttcttaatggtatttatagaaaagatgttttcatattataatgc

SEQ ID NO: 319892 - DNA, 3544 bp, Homo sapiens
cgactctagcggagcttatgggtgtcatccccccatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtcggtaaataaccaatattgcaaaaaggtgattggcgggatggtgtggaacccagccatgcggagatccttatcagtggagcacttagaaaccaagagtctgccttctcgttcccctcccattactcccaactggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacattta

SEQ ID NO: 319893 - DNA, 3457 bp, Homo sapiens
cagtggggctgccatcatttctacagagaagtaaactctaggcagccaagagcccccactcatcaggatcatggagtaaaggacatgcattgagaggcatcagcttcaacctggccgatccctgatgtgctttgtttgtgttttgttttattttttgaagggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtcggtaaataaccaatattgcaaaaaggtgattggcgggatggtgtggaacccagccatgcggagatccttatcagtggagcacttagaaaccaagagtctgccttctcgttcccctcccattactcccaactggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacattta

SEQ ID NO: 319894 - DNA, 2888 bp, Homo sapiens
gtgggatgaacagccagaaaagcagcccccaccacctctgttaggtgggagacctcttcctgccggtgggaagccactttgtgctgggtcttcagaggaggctggccctcctgagggtctgggaacccccattgctccaggagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacattta

SEQ ID NO: 319895 - DNA, 2444 bp, Homo sapiens
aattgggatagggtgggtatgctcataggaagatagctcaacacagagaatcagaacctgattgggggtgagaagaacatccacaggtagtgatgaaccagggtgtgatactggagtctatgagagtgaggaagatttctacataataggcctgattgatggttaaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacattta

SEQ ID NO: 319896 - DNA, 2662 bp, Homo sapiens
aaaggcgacccccttggagcggattgcgggcccggaacaaaattttccaggaggccaaacccgtaaagggaaagggcccctgcaagaatacttgttaggtttgccagcagtagaatctgcatctgggactgtgcctggaaaggggcactatggaaggtcccaaaattactagcaacgatttcaattcagcaaacctttctgggaaggacacttaggttgagtagaacatagcataagaagtgccaatatagccgggtgcagtgactcacgcctgtaatcccagcactttgggaggtccaggcgggcagatcagttgaggtcaggagtttgagaccagcctggccagcatgagaaaaccctgtctctactaaaaatacaaaaattagccaggcatggtgatgcacacctgtagtcccagctactcggaaggctgaggcacgagaatcgcttgaacctgggaggtggacgttacagtgagccgagatcacgtcactgcactccagcctgggcaacaaagagagaccctgtctcaggaagagaaaaaaaaagtgccacaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacattta

SEQ ID NO: 319897 - DNA, 1115 bp, Homo sapiens
cacagcattattgattatccaggcccagggggattgcaaatcatggaggccctgacagtcctgaggagaaatggtcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacattta

SEQ ID NO: 319898 - DNA, 1070 bp, Homo sapiens
cgactctagcggagcttatgggtgtcatccccccatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtcggtaaataaccaatattgcaaaaaggtgattggcgggatggtgtggaacccagccatgcggagatccttatcagtggagcacttagaaaccaagagtctgccttctcgttcccctcccattactcccaactggtatgtcctccttttttttttttttgtactacccaacagtagacactttatctcttttaaaaataaaaactcaacttataaactcctaaagatagatgacctacaatttgcattttaggctcttggcagaagtaactgttttcatgaagtacacaagtctagctaaatgttttccatcgtgtataatgctgagatgctctttttaaaaaaacttattcaatctaaatagtttgggaaactcgagcctgctgaaaggcctcctttggaatcacagcacacattagcatattaaacactctgagacgtccaataataaaaaagtacggttagctttacttaattcatgttttccattaatatcccacaaaataaactttagggaaaactaacgcaggtacg

SEQ ID NO: 319899 - DNA, 229 bp, Homo sapiens
tcccaacacactgcagcaagaacaaaccaggtaacaacatttttttaaagttttctgtttagtgtataaaaatgagtaaccactaaaaatgtactcttcattttattactatggccaaataacttcatttgggtgtaactacaccaacaatgatgatccaagtaaaaatctggggtgcacatactgacattttaatcacctaatgagttttcagtcttgggcctgcttc

SEQ ID NO: 319900 - DNA, 466 bp, Homo sapiens
ttattgttgtgtgtctgtctgaaagggcccctgcaagaatacttgttaggtttgccagcagtagaatctgcatctgggactgtgcctggaaaggggcactatggaaggtcccaaaattactagcaacgatttcaattcagcaaacctttctgggaaggtaggtagaggctccaagaccccgctagatggtttctcttgccctctggctgggtcagatacaaaggaaaagcgatgtcctagtgtgggtgagctacccgtgagtagtgaactgttaatttgtctaccaagtggtactaaaacaacctcttggggtgggctctttgggaaaaatgggttaccctcagcttagttatagggcactatgtctaagaaagctgaaattgctttgaaattctcttgggcatgctttattcacatggttggcactcatttttgaaagcagcagatcccattattccttgactct

SEQ ID NO: 319901 - DNA, 3596 bp, Homo sapiens
cgactctagcggagcttatgggtgtcatccccccatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtcggtaaataaccaatattgcaaaaaggtgattggcgggatggtgtggaacccagccatgcggagatccttatcagtggagcacttagaaaccaagagtctgccttctcgttcccctcccattactcccaactggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacattta

SEQ ID NO: 319902 - DNA, 3549 bp, Homo sapiens
cgactctagcggagcttatgggtgtcatccccccatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagtcggtaaataaccaatattgcaaaaaggtgattggcgggatggtgtggaacccagccatgcggagatccttatcagtggagcacttagaaaccaagagtctgccttctcgttcccctcccattactcccaactggcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacattta

SEQ ID NO: 319903 - DNA, 3461 bp, Homo sapiens
cgactctagcggagcttatgggtgtcatccccccatccaggctatctttccgatagtcactttatacccgatcaaaatgaggactttttaacaaaagtcgaatctctgcatgagcagcacagtgggctaaaacaatcagaagcagaatcctgctatatcaacatagcgcggaccctcgacttctatggagtagaactgcacagtggtagggatctgcacaatttagacctaatgattggaattgcttccgcgggtgttgctgtgtaccgaaaatacatttgcacaagtttctatccttgggtgaacattctcaaaatttctttcaaaaggaaaaagttcttcatacatcagcgacagaaacaggctgaatccagggaacatattgtggccttcaacatgctgaattaccgatcttgcaaaaacttgtggaaatcctgtgttgagcaccatacgttctttcaggcaaagaagctactacctcaggaaaagaatgttctgtctcagtactggactatgggctctcggaacaccaaaaagcgaagtcctcggctccggcacgaaatccgaaagccacgccactcttctgcagataaccttgcaaatgaaatgacctacatcacggaaacggaagatgtattttacacgtacaagggctctctggcccctcaagacagcgattctgaagtttctcagaaccgaagcccgcaccaagagagtttatccgagaacaatccggcacaaagctacctgacccagaagtcatccagttctgtgtctccatcttcaaatgctccaggctcctgctcacctgacggcgttgatcagcagctcttagatgacttccacagggtgaccaaagggggctccaccgaggacgccagccagtactactgtgacaagaatgataatggtgacagctacttagtcttgatccgtatcacaccagatgaagatggaaaatttggatttaatcttaagggaggagtggatcaaaagatgcctcttgtggtatcaaggataaacccagagtcacctgcggacacctgcattcctaagctgaacgaaggggatcaaatcgtgttaatcaatggccgggacatctcagaacacacgcatgaccaagtggtgatgttcatcaaagccagccgggagtcccactcacgggagctggccctggtgatcaggaggagagctgtccgctcatttgctgacttcaagtctgaagatgaactgaaccagcttttccccgaagccattttccccatgtgtccggagggtggggacactttggagggatccatggcacagctaaagaagggcctcgaaagcgggacggtgctgatccagtttgagcaactctacagaaaaaagccaggtttggccatcacgtttgcaaagctgcctcaaaatttggacaaaaaccgatataaagatgtgctgccttatgacaccacccgggtattattgcagggaaatgaagattatattaatgcaagttacgtgaacatggaaattcctgctgctaaccttgtgaacaagtacatcgccactcaggggcccctgccgcatacctgtgcacagttttggcaggttgtctgggatcagaagttgtcactcattgtcatgttgacgactctcacagaacgagggcggaccaaatgtcaccagtactggccagatccccccgacgtcatgaaccacggcggctttcacatccagtgtcagtcagaggactgcaccatcgcctatgtgtcccgagaaatgctggtcacaaacacccagaccggggaagaacacacagtgacacatctccagtacgtcgcatggcctgaccacggtgtgcccgatgactcctccgactttctggaatttgtaaactatgtgaggtctctgagagtggacagcgagcccgtcctagttcactgcagtgctggaataggtcgaaccggtgtgttggtcactatggaaacagccatgtgcctaactgagaggaacctgcccatttacccactggatattgtccgaaaaatgcgagaccagcgcgccatgatggtgcagacatcaagccagtacaagtttgtgtgtgaagcgattcttcgtgtgtatgaagaaggtttagtccaaatgctggatcctagttaagacaactgtgaaaaagttcattcctctttcccaagggcatcctccttgaaagaggaggacagacctctctggaagcagcaagaggaaccagtagctgtgggaaaggaatgggcacctctgaacccaggcactttaaacttctatagaaaagatatcgtgtacataggaactggtgtagataagcatgcaattatggcatcatttaggcctgtatttctatggaaagatacaaaaaggatctcagtttggggcctgtcctaatgccttcttccctaacatcaccacacacacccctgtcggcatcctggagcaattgagaccggacacccacagagctgttgtcctcccagcaacaagatggtgtggttatcttgggtcatttggatgttttgtttgtttctgtgtgtcagactgtaagggctgagctttctgtgcttctaggtggagctggaacaattcagattcacccgccctgatgctaaggaaaccctgacgtatgtactagatggcagggcactgggggtcaggctgaaggctgagcaacacctctctgccctccctccctttgtcccatctcccagcgacttccaatattcatgtttctgagaattgtgtccctcttcaggttccctcttggtgcctaacctggattagtaatgtgcattcaggtgaattttcagctgaggctctgagaactggtactctcagtgtgttctggtcatcttgtggcttagttgtagaagcaggtgtgtctcttgcctctgcttgcctcctactgcacactcagcacccaggactggaatcaccgactactgaatctcctacatgtattgctgctacttcaagctcctccacttgaaaccttatgattttcccaaggggagatgggacagtgtcatctaaatattccgaatgtttggccttctgagaaaagagcttctagtaattgaaccatgggaaacccagcttctggagggttggccgtggggctgtgtacatgtgtgtgcccaggggtgagtgtttctcaggattcctaacgattcaaattaccgttgagtatatataaagaatgagtctctgtatggaagaacaaatgtgtgcattcacccccagtcacaatggtctccattgcatttcaaaggagaggatcagactatctgaatataaacacaatctgatgttaatttattctaagaacaccatcattttgattgtcctaaagaattctgcctttgtgaataccgtgttaaatttttttaaatttgtgacaggattgtagcaaattattatttaaggaaaataaattgtgtaaacattta

SEQ ID NO: 319904 - DNA, 771 bp, Homo sapiens
ctgcaggttattcagcgatagttatgacctcccggttacgtgcgttgggtggaagaattaataatatacgcacctcggagttacccaaagagaaaactcgatcagaagtcatttgcagcatccactttttagatggcgtggtacagacctttaaagttactaaacaagacactggccaggttcttctggatatggtgcacaaccacctgggtgtgactgaaaaggaatattttggtttacagcatgatgacgactccgtggactctcctagatggctggaagcaagcaaacccatcaggaagcagttaaaaggttggtgtgatcttttcatttcagtcgaacattaggtgttagtgtatcacagcctgtttctcccctccaatcgtcagtgcctgtgacatctggtacctgtagttccgggtgtccaggagtcatgagtgagccgacttctccctgtctgacttctgagtcagcagagatgcttccagatcagccctctaggatccgccccagctgtgggaaagaaggggaagggtgagagtaggcagctcagagcgagggaacccacatttctgtattcaaggaaggaaaaggaaggaggatggccttacttagcccgatgtgagagccagggtggacaagagagacagggagatagacaaacacaaacacctcatactttccaacagcatagtcgcgttcacggaaaaccgaaccataagtaggtaatgtcaccaatataaaagattaagtcttccaaactaccgctta

SEQ ID NO: 319905 - DNA, 3423 bp, Homo sapiens
  misc_feature (2308)..(2308): n is a, c, g, or t
  misc_feature (2324)..(2324): n is a, c, g, or t
  misc_feature (2329)..(2329): n is a, c, g, or t
  misc_feature (2340)..(2340): n is a, c, g, or t
  misc_feature (2346)..(2346): n is a, c, g, or t
  misc_feature (2399)..(2399): n is a, c, g, or t
  misc_feature (2471)..(2471): n is a, c, g, or t
  misc_feature (2492)..(2492): n is a, c, g, or t
  misc_feature (2507)..(2508): n is a, c, g, or t
  misc_feature (2521)..(2521): n is a, c, g, or t
  misc_feature (2524)..(2524): n is a, c, g, or t
  misc_feature (2559)..(2559): n is a, c, g, or t
tggacagcacacaggaggcacctctaggtcctggacccctcgctcagcctggcccctaagactccacctcctctcctcctctcagaggaggatggtacaccagaagggcctgtcaccccagctaccacagtgcatgctccagaggagcctgatactgcagctgtcagagtgtccaccccagaggagcccgcctccccagctgctgcagtgcccaccccagaggagcccacctccccagctgctgcagtgcccaccccagaggagcccacctccccagctgctgcagtgccccccccagaggagcccacctccccagctgctgcagtgcccaccccagaggagcccacctccccagctgctgcagtgcccaccccagaggagcccacctccccagctgctgcagtgcccaccccagaggagcccacctccccagctgctgcagtgcccaccccagaggagcccacctccccagctgctgcagtgcccaccccagaggagcccacctccccagctgctgcagtgcccaccccagaggagcccgcctccccagctgctgcagtgcccaccccagaggagcccgcctccccagctgctgcagtgcccaccccagaggagcctgccttcccagctcctgcagtgcccaccccagaggaatccgcctccgcagctgttgcagtgcccacccccgaggaatctgcctccccagctgctgcagtgcccaccccagcagaatctgcctcctttgcagctgtggtggccaccctggaggaacccacttccccggcagcttcagtgcccacccctgcagctatggtggccaccctagaggaattcacttccccggcagcttcagtgcccacctctgaggagcctgcctccctagcagctgcagtgtccaacccagaggagcccacctccccagcagcagcagtgcccaccctagaggaacccacctcctcagcagctgcagtgctcaccccagaggaactcagttccccagcagcttcagtgcccacccccgaggagcctgcctccccagcagctgcagtgtccaacctagaggagcccgcctccccagcagcagcagtgcccaccccagaggtggctgccatccctgctgcttcagtgcccaccccagaggtgcctgccatcccagctgctgcagtgcctcctatggaggaagtttcccccattggtgtgcccttcctgggagtttctgcccacactgactcagtgcctatttcagaagaaggaacacctgttctagaggaggcttcctccactggaatgtggatcaaggaggaccttgattccctagtatttggcataaaagaggtgaccagcacagtgctacatgggaaagtgcctctggctgcaaccgctggattaaattcagatgaggtaattgtccattttgattctgggaagggtctaaagagtaaagtgagatttgcagggctgacctggtggtgatgagaaatggcacagatagttcttttgttctttttgggtctcccgggcttatagtttgtagtctttctgttcagtttttggggaaaatatactttaattttgtctggtgaaagactttataatttcatgcttcgttttttattcagataagccaatcccacggaaaacagggatataaacagttgttgatttacatttttaaaaagattattagcaggaaagggtcattctgtttttgaattatacagtgagcatgttcttgcctaaaccaagagacagtttattcattggtggtgtcaacatttaggtagaggccagagtgtgagctttggaatgagacctggggtgcttcctaaccactctgggaaaattagttagctattcttgagtttcctgtttcttcatttgttaaggcataactctgtgaggataaaatgagatacatttaaggtaccaagcgtataagattaccaatcactggccatatcctccccattcttttcaaataggtatgttggttggttgaaagaatttaccaaagtagattggagagaagcaataaagctaaatgattaagaacttttaaatgcaaatatgtgtttctgaaaaccagagctaggcataatgtttatgaaaaatagagatattttagtcatctttgtcaaactgcctttgtgtccttaagcaagtcattttcctttccaggacctcatttcttcattataaaacaagaaaattgggctaaatgtcctcttgggtctctcttggctctaagattctttttattttttttttttagatggagtctggctctgtcagtcaggctggagtgctngagtgcagtggtgcgntctcngctcactgcangctccncctcccgggttcacgccattctcctgcctcagcctcccgagtagctgggactncaggcgcccgccactacgcccggcaattttttgtatatatatatatataattttttttttttttttttagtngagacgggtttcactgtgttngccaggatggtctcnntctcctgacctcntgntctgcccgcctcggcctcccagagtgctgggattncaggcgtgagccaccgcgcccagccggctctaagattcttaatgttagagaaccgaatgtgttaggaaacagttggaaacgatgttccacatccttgagcactcctagtccaaggaatttgagatcagcagctttccacagttaattacccaggtttgatttggtcagtggtaaagagtgcaggagttagaggtttaatctgaacacaagagatgactgagtgagaagattgttttgattttactgcgcccctaggactcaaaatagtgccttcttcatagcaggcatttgctgttgactgactgactgaatgcatgaatatcaatttcctagactatggatggatgctacaagaaagatgggttttctcattcacctcactgcagagcctttcagggcagccttaagtcagctagagcaccagctaaacatgcaggtcctgacaacaaaatcattttgattgcatgccataaactctttgattaagaggattgattaagataatctggccttgctgagtggtggtggttttaccttgagctttaccagttattttgtcaggtagcattccattaaattaggatgcatcatctttgagactgatggatttttgattcatttttccgagttttattgaatttggaatgacaccgagatcccaatagcctgtacaaagtgaagacagtaggtcaacaacagagccattcttgataatacagaatatttcacaccaggcacagtggctcacgcctctaatcccaacatttgggaagccaagggaagaggattgcttgaggccaggagttcgagaacagcctaggcaacatagtaagaccccatctctgagaaaataaaaagaaaaaa

SEQ ID NO: 319906 - DNA, 4335 bp, Homo sapiens
  misc_feature (3220)..(3220): n is a, c, g, or t
  misc_feature (3236)..(3236): n is a, c, g, or t
  misc_feature (3241)..(3241): n is a, c, g, or t
  misc_feature (3252)..(3252): n is a, c, g, or t
  misc_feature (3258)..(3258): n is a, c, g, or t
  misc_feature (3311)..(3311): n is a, c, g, or t
  misc_feature (3383)..(3383): n is a, c, g, or t
  misc_feature (3404)..(3404): n is a, c, g, or t
  misc_feature (3419)..(3420): n is a, c, g, or t
  misc_feature (3433)..(3433): n is a, c, g, or t
  misc_feature (3436)..(3436): n is a, c, g, or t
  misc_feature (3471)..(3471): n is a, c, g, or t
ggagactgcagtcaaactgaggggaatggtgaggagtgcattgagagggtcaccttcagttttgcttttaatcatgaactaacagatgttacctcaggacctgaagtagaggtgttatatgaatcaaatttactaacagatgaaattcatttggaaagtgggaatgtaactgttaatcaagaaaataacagtctgacatcaatgggaaatgtggtcacttgtgaattgtctgtggagaaagtttgtgatgaggatggtgaggcaaaagagctggattatcaagccacacttttggaggatcaagctccagcacatttccacagaaacttcccagagcaggtcttccaggatctccagaggaagtccccagagtcagagattctgagtctgcacctgctggttgaagaactgagacttaatccagatggagtggaaactgtgaatgatacaaagcctgagctgaatgtggcatcatcagagggaggggagatggaaaggagagattcagattcattcctaaatatttttccagagaaacaagttaccaaggctggtaatactgaaccagttttagaggaatggatacccgtcctccagagaccttcccggactgctgcagtacccactgtcaaagatgccctagatgctgcactgcccagcccagaggagggtacctcaattgctgcagtgcctgccccagagggaactgctgtagttgctgctttagtgccctttccacatgaggacatcctagttgcttcaatagtctccttagaggaggaggatgtcacagctgctgcagtatcagccccagagagggctactgtcccagctgttacagtatctgtccctgaagggactgctgcagttgctgcagtgtcctccccagaggagactgctccagctgttgcagcagccatcacacaggagggtatgtcagctgtcgcagggttctccccagagtgggctgctttagctattacagtacccatcacagaggaggatggtacaccagaagggcctgtcaccccagctaccacagtgcatgctccagaggagcctgatactgcagctgtcagagtgtccaccccagaggagcccgcctccccagctgctgcagtgcccaccccagaggagcccacctccccagctgctgcagtgcccaccccagaggagcccacctccccagctgctgcagtgccccccccagaggagcccacctccccagctgctgcagtgcccaccccagaggagcccacctccccagctgctgcagtgcccaccccagaggagcccacctccccagctgctgcagtgcccaccccagaggagcccacctccccagctgctgcagtgcccaccccagaggagcccacctccccagctgctgcagtgcccaccccagaggagcccacctccccagctgctgcagtgcccaccccagaggagcccgcctccccagctgctgcagtgcccaccccagaggagcccgcctccccagctgctgcagtgcccaccccagaggagcctgccttcccagctcctgcagtgcccaccccagaggaatccgcctccgcagctgttgcagtgcccacccccgaggaatctgcctccccagctgctgcagtgcccaccccagcagaatctgcctcctttgcagctgtggtggccaccctggaggaacccacttccccggcagcttcagtgcccacccctgcagctatggtggccaccctagaggaattcacttccccggcagcttcagtgcccacctctgaggagcctgcctccctagcagctgcagtgtccaacccagaggagcccacctccccagcagcagcagtgcccaccctagaggaacccacctcctcagcagctgcagtgctcaccccagaggaactcagttccccagcagcttcagtgcccacccccgaggagcctgcctccccagcagctgcagtgtccaacctagaggagcccgcctccccagcagcagcagtgcccaccccagaggtggctgccatccctgctgcttcagtgcccaccccagaggtgcctgccatcccagctgctgcagtgcctcctatggaggaagtttcccccattggtgtgcccttcctgggagtttctgcccacactgactcagtgcctatttcagaagaaggaacacctgttctagaggaggcttcctccactggaatgtggatcaaggaggaccttgattccctagtatttggcataaaagaggtgaccagcacagtgctacatgggaaagtgcctctggctgcaaccgctggattaaattcagatgaggtaattgtccattttgattctgggaagggtctaaagagtaaagtgagatttgcagggctgacctggtggtgatgagaaatggcacagatagttcttttgttctttttgggtctcccgggcttatagtttgtagtctttctgttcagtttttggggaaaatatactttaattttgtctggtgaaagactttataatttcatgcttcgttttttattcagataagccaatcccacggaaaacagggatataaacagttgttgatttacatttttaaaaagattattagcaggaaagggtcattctgtttttgaattatacagtgagcatgttcttgcctaaaccaagagacagtttattcattggtggtgtcaacatttaggtagaggccagagtgtgagctttggaatgagacctggggtgcttcctaaccactctgggaaaattagttagctattcttgagtttcctgtttcttcatttgttaaggcataactctgtgaggataaaatgagatacatttaaggtaccaagcgtataagattaccaatcactggccatatcctccccattcttttcaaataggtatgttggttggttgaaagaatttaccaaagtagattggagagaagcaataaagctaaatgattaagaacttttaaatgcaaatatgtgtttctgaaaaccagagctaggcataatgtttatgaaaaatagagatattttagtcatctttgtcaaactgcctttgtgtccttaagcaagtcattttcctttccaggacctcatttcttcattataaaacaagaaaattgggctaaatgtcctcttgggtctctcttggctctaagattctttttattttttttttttagatggagtctggctctgtcagtcaggctggagtgctngagtgcagtggtgcgntctcngctcactgcangctccncctcccgggttcacgccattctcctgcctcagcctcccgagtagctgggactncaggcgcccgccactacgcccggcaattttttgtatatatatatatataattttttttttttttttttagtngagacgggtttcactgtgttngccaggatggtctcnntctcctgacctcntgntctgcccgcctcggcctcccagagtgctgggattncaggcgtgagccaccgcgcccagccggctctaagattcttaatgttagagaaccgaatgtgttaggaaacagttggaaacgatgttccacatccttgagcactcctagtccaaggaatttgagatcagcagctttccacagttaattacccaggtttgatttggtcagtggtaaagagtgcaggagttagaggtttaatctgaacacaagagatgactgagtgagaagattgttttgattttactgcgcccctaggactcaaaatagtgccttcttcatagcaggcatttgctgttgactgactgactgaatgcatgaatatcaatttcctagactatggatggatgctacaagaaagatgggttttctcattcacctcactgcagagcctttcagggcagccttaagtcagctagagcaccagctaaacatgcaggtcctgacaacaaaatcattttgattgcatgccataaactctttgattaagaggattgattaagataatctggccttgctgagtggtggtggttttaccttgagctttaccagttattttgtcaggtagcattccattaaattaggatgcatcatctttgagactgatggatttttgattcatttttccgagttttattgaatttggaatgacaccgagatcccaatagcctgtacaaagtgaagacagtaggtcaacaacagagccattcttgataatacagaatatttcacaccaggcacagtggctcacgcctctaatcccaacatttgggaagccaagggaagaggattgcttgaggccaggagttcgagaacagcctaggcaacatagtaagaccccatctctgagaaaataaaaagaaaaaa

SEQ ID NO: 319907 - DNA, 983 bp, Homo sapiens
gttgtgacctgacgtcacttttcttgagttacctcccgcagccgcagccgccgtgctcagcgcgagccccggagcccttgagcgcgaggcgcggagcccccggagcccccaaaccgcagacacatccccgcgccccagagccccggcctgcgcgcccagccgggcccgcgcgatgccctcagaccggcctttcaagcagcggcggagcttcgccgaccgctgtaaggaggtacagcagatccgcgaccagcaccccagcaaaatcccggtgatcatcgagcgctacaagggtgagaagcagctgcccgtcctggacaagaccaagtttttggtcccggaccatgtcaacatgagcgagttggtcaagatcatccggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttctgagccagcagtaggggggctcggcctgggagtcggggggccccggtcaggccctgcccagagagctcctggttcctgaactgagctgcctctaccgtggtgggctgggcaggcatgtgcccccctagtcagagggcaccaacccacctactctgcccctgggtggatcctgggccggtcgtgttagggttgtccctctgggtgctggctggtgggatgggggagggtggggagcagctcccagcacccctgctgtgtggttcatcttttttttaggcccctgcctgtctgcccatctgcccctcacccacccgaggctctgcccaccgcctggacctgcccacccctgaaagactggcccctggctccccgcccctcggtctccacgtggtgtatggatctgtggtcattgtccctctgcagaataaagattgctcaggcctgcctg

SEQ ID NO: 319908 - DNA, 717 bp, Homo sapiens
gttgtgacctgacgtcacttttcttgagttacctcccgcagccgcagccgccgtgctcagcgcgagccccggagcccttgagcgcgaggcgcggagcccccggagcccccaaaccgcagacacatccccgcgccccagagccccggcctgcgcgcccagccgggcccgcgcgatgccctcagaccggcctttcaagcagcggcggagcttcgccgaccgctgtaaggaggtacagcagatccgcgaccagcaccccagcaaaatcccggtgatcatcgagcgctacaagggtgagaagcagctgcccgtcctggacaagaccaagtttttggtcccggaccatgtcaacatgagcgagttggtcaagatcatccggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttctgagccagcagcccctgcctgtctgcccatctgcccctcacccacccgaggctctgcccaccgcctggacctgcccacccctgaaagactggcccctggctccccgcccctcggtctccacgtggtgtatggatctgtggtcattgtccctctgcagaataaagattgctcaggcctgcctg

SEQ ID NO: 319909 - DNA, 277 bp, Homo sapiens
ctgccttggcctttgaaaagtgcttgggttacaggcgtgagcctctggacctggcagagccaactgttaatggcagaatgtaactgggtgtaagagggaccactaccattatttcaagtgtgtttgaacgctttcataatgaaatgcccagaaaaattatacagcatattggaaggcctccctgaggagacacttgaaccaaaactcggtctccacgtggtgtatggatctgtggtcattgtccctctgcagaataaagattgctcaggcctgcctg

SEQ ID NO: 319910 - DNA, 871 bp, Homo sapiens
gttgtgacctgacgtcacttttcttgagttacctcccgcagccgcagccgccgtgctcagcgcgagccccggagcccttgagcgcgaggcgcggagcccccggagcccccaaaccgcagacacatccccgcgccccagagccccggcctgcgcgcccagccgggcccgcgcgatgccctcagaccggcctttcaagcagcggcggagcttcgccgaccgctgtaaggaggtacagcagatccgcgaccagcaccccagcaaaatcccggtgatcatcgagcgctacaagggtgagaagcagctgcccgtcctggacaagaccaagtttttggtcccggaccatgtcaacatgagcgagttggtcaagatcatccggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttctgagccagcagtaggggggctcggcctgggagtcggggggccccggtcaggccctgcccagagagctcctggttcctgaactgagctgcctctaccgtggtgggctgggcaggcatgtgcccccctagtcagagggcaccaacccacctactctgcccctgggtggatcctgggccggtcgtgttagggttgtccctctgggtgctggctggtgggatgggggaggttgatctctctttccatgtccttcttctcttaggcaagtaatactttcattatgtgtctgtttttattaattatgtcaattgatgtcttttcattgtcatatatcgcact

SEQ ID NO: 319911 - DNA, 719 bp, Homo sapiens
gttgtgacctgacgtcacttttcttgagttacctcccgcagccgcagccgccgtgctcagcgcgagccccggagcccttgagcgcgaggcgcggagcccccggagcccccaaaccgcagacacatccccgcgccccagagccccggcctgcgcgcccagccgggcccgcgcgatgccctcagaccggcctttcaagcagcggcggagcttcgccgaccgctgtaaggaggtacagcagatccgcgaccagcaccccagcaaaatcccggtgatcatcgagcgctacaagggtgagaagcagctgcccgtcctggacaagaccaagtttttggtcccggaccatgtcaacatgagcgagttggtcaagatcatccggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttctgagccagcagtaggggggctcggcctgggagtcggggggccccggtcaggccctgcccagagagctcctggttcctgaactgagctgcctctaccgtggtgggctgggcaggcatgtgcccccctagtcagagggcaccaacccacctactctgcccatatcccttcatctaagcgcacctcg

SEQ ID NO: 319912 - DNA, 896 bp, Homo sapiens
gactccatggcttccgagttgctgactgaccctccacctcagaggtagttctgacactgtctcagttttgcagatgaagatgagattcttcagttctccatgtggaaaagcagctgtggacccagccgaccgctgtaaggaggtacagcagatccgcgaccagcaccccagcaaaatcccggtgatcatcgagcgctacaagggtgagaagcagctgcccgtcctggacaagaccaagtttttggtcccggaccatgtcaacatgagcgagttggtcaagatcatccggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttctgagccagcagtaggggggctcggcctgggagtcggggggccccggtcaggccctgcccagagagctcctggttcctgaactgagctgcctctaccgtggtgggctgggcaggcatgtgcccccctagtcagagggcaccaacccacctactctgcccctgggtggatcctgggccggtcgtgttagggttgtccctctgggtgctggctggtgggatgggggagggtggggagcagctcccagcacccctgctgtgtggttcatcttttttttaggcccctgcctgtctgcccatctgcccctcacccacccgaggctctgcccaccgcctggacctgcccacccctgaaagactggcccctggctccccgcccctcggtctccacgtggtgtatggatctgtggtcattgtccctctgcagaataaagattgctcaggcctgcctg

SEQ ID NO: 319913 - DNA, 449 bp, Homo sapiens
agcgggcggctgcggggctgccgggcagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttcttta

SEQ ID NO: 319914 - DNA, 3930 bp, Homo sapiens
  misc_feature (44)..(44): n is a, c, g, or t
ggaatctcagccgccgtctgagggctgaggcagcgtggggacgngtgcgcagtgcgcgggctggccgtcgcggacgccgctccgggcagccgagcctctgtgggagccggggccgcggcggcgcgggtgctccgggccgaggccgcgctgctggagcgcggttcccgctgtggcgagcggggaggcgtccgcagaggggcggtgggtgctgtctggctcttgctgattgaattcctttggtgcagtttagcatgttcctctgtgttctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttgggagacgggctctcgctctgttggctcaggctggagtgcagtggcgtgatctcagctcactacagcctccacctcgtgggttcaaacagttgtgctgcctcagcttcccgagtagctaggattacaggtgcatgccaccacacctggctaattttggtattttagtagagatggggtttcaccatgttggccaggctcgtctcgaactcctgacttcaggtgatccacccatctcagcctcccaaagtgctgggattacaggcgtgagccaccatgcccggcccataagtaccgttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctga

SEQ ID NO: 319915 - DNA, 4011 bp, Homo sapiens
  misc_feature (44)..(44): n is a, c, g, or t
ggaatctcagccgccgtctgagggctgaggcagcgtggggacgngtgcgcagtgcgcgggctggccgtcgcggacgccgctccgggcagccgagcctctgtgggagccggggccgcggcggcgcgggtgctccgggccgaggccgcgtctggctcttgctgattgaattcctttggtgcagtttagcatgttcctctgtgttctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctatgcggcaggccagaaggctgtcgaacccttgtatacagaggtatacatcaagagctggtgaatgcagcacgtatgtgggctctcacgcaaacgtgccttcttagtggagggcccagacttactacttacaactgatcatagaaagagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttgggagacgggctctcgctctgttggctcaggctggagtgcagtggcgtgatctcagctcactacagcctccacctcgtgggttcaaacagttgtgctgcctcagcttcccgagtagctaggattacaggtgcatgccaccacacctggctaattttggtattttagtagagatggggtttcaccatgttggccaggctcgtctcgaactcctgacttcaggtgatccacccatctcagcctcccaaagtgctgggattacaggcgtgagccaccatgcccggcccataagtaccgttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctga

SEQ ID NO: 319916 - DNA, 4094 bp, Homo sapiens
  misc_feature (44)..(44): n is a, c, g, or t
ggaatctcagccgccgtctgagggctgaggcagcgtggggacgngtgcgcagtgcgcgggctggccgtcgcggacgccgctccgggcagccgagcctctgtgggagccggggccgcggcggcgcgggtgctccgggccgaggccgcgtctggctcttgctgattgaattcctttggtgcagtttagcatgttcctctgtgttctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctatgcggcaggccagaaggctgtcgaacccttgtatacagaggtatacatcaagagctggtgaatgcagcacgtatgtgggctctcacgcaaacgtgccttcttagtggagggcccagacttactacttacaactgatcatagaaagttgagttaaccaaactgccttttgcagttatcataactgattttgtcaatactaacgcaaactgtttcactgtagtcatcaggagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttgggagacgggctctcgctctgttggctcaggctggagtgcagtggcgtgatctcagctcactacagcctccacctcgtgggttcaaacagttgtgctgcctcagcttcccgagtagctaggattacaggtgcatgccaccacacctggctaattttggtattttagtagagatggggtttcaccatgttggccaggctcgtctcgaactcctgacttcaggtgatccacccatctcagcctcccaaagtgctgggattacaggcgtgagccaccatgcccggcccataagtaccgttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctga

SEQ ID NO: 319917 - DNA, 3796 bp, Homo sapiens
  misc_feature (44)..(44): n is a, c, g, or t
ggaatctcagccgccgtctgagggctgaggcagcgtggggacgngtgcgcagtgcgcgggctggccgtcgcggacgccgctccgggcagccgagcctctgtgggagccggggccgcggcggcgcgggtgctccgggccgaggccgcgtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttgggagacgggctctcgctctgttggctcaggctggagtgcagtggcgtgatctcagctcactacagcctccacctcgtgggttcaaacagttgtgctgcctcagcttcccgagtagctaggattacaggtgcatgccaccacacctggctaattttggtattttagtagagatggggtttcaccatgttggccaggctcgtctcgaactcctgacttcaggtgatccacccatctcagcctcccaaagtgctgggattacaggcgtgagccaccatgcccggcccataagtaccgttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctga

SEQ ID NO: 319918 - DNA, 4066 bp, Homo sapiens
  misc_feature (44)..(44): n is a, c, g, or t
  misc_feature (4002)..(4002): n is a, c, g, or t
ggaatctcagccgccgtctgagggctgaggcagcgtggggacgngtgcgcagtgcgcgggctggccgtcgcggacgccgctccgggcagccgagcctctgtgggagccggggccgcggcggcgcgggtgctccgggccgaggccgcgtctggctcttgctgattgaattcctttggtgcagtttagcatgttcctctgtgttctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttgggagacgggctctcgctctgttggctcaggctggagtgcagtggcgtgatctcagctcactacagcctccacctcgtgggttcaaacagttgtgctgcctcagcttcccgagtagctaggattacaggtgcatgccaccacacctggctaattttggtattttagtagagatggggtttcaccatgttggccaggctcgtctcgaactcctgacttcaggtgatccacccatctcagcctcccaaagtgctgggattacaggcgtgagccaccatgcccggcccataagtaccgttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctgaaaaaaaaacacaccaaaaaaaatttttggggccgccgggcttgaaagaagtttttagacccttcctgtggggcggggcccgggttgttgacctgggccaggtccaaggaaacgggccggccgggtgtgtgttcccncaaaaaagcgcgggccgcggtcggacaatccagggccgggcctcggtccaccgggccggcctac

SEQ ID NO: 319919 - DNA, 3772 bp, Homo sapiens
ttccaaagttgctatgtcattttgcatttccaccagcaatatatgatagttcgtttatttcacatctttgacagcatttagtgttgtcagggttttttttgtttgttttagacattttagtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttgggagacgggctctcgctctgttggctcaggctggagtgcagtggcgtgatctcagctcactacagcctccacctcgtgggttcaaacagttgtgctgcctcagcttcccgagtagctaggattacaggtgcatgccaccacacctggctaattttggtattttagtagagatggggtttcaccatgttggccaggctcgtctcgaactcctgacttcaggtgatccacccatctcagcctcccaaagtgctgggattacaggcgtgagccaccatgcccggcccataagtaccgttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctga

SEQ ID NO: 319920 - DNA, 3427 bp, Homo sapiens
ggagtacatacatggactataatttttatatgtatctgtcaaccgtatgcaaacggatgaataattagaaattctgcgagaaaacaggttcacatgtataatgctggttgcaaaatgattcattttatttactatttcaggtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttgggagacgggctctcgctctgttggctcaggctggagtgcagtggcgtgatctcagctcactacagcctccacctcgtgggttcaaacagttgtgctgcctcagcttcccgagtagctaggattacaggtgcatgccaccacacctggctaattttggtattttagtagagatggggtttcaccatgttggccaggctcgtctcgaactcctgacttcaggtgatccacccatctcagcctcccaaagtgctgggattacaggcgtgagccaccatgcccggcccataagtaccgttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctga

SEQ ID NO: 319921 - DNA, 3256 bp, Homo sapiens
aaacacataaaatcatacaataaaagatgaaagccaggcaccagaaattgaattaggaattcaaagcctgggtagctagagagggatgaggtttaatttatcgcatctctaagggaagtaatgagatttttcactgcttggcatgtctgattgtgggttcatatcagggtaattaagtggtgactaacatttgacattcttagaaacacaagtcttatgtctgtgttcatctctggtagatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttgggagacgggctctcgctctgttggctcaggctggagtgcagtggcgtgatctcagctcactacagcctccacctcgtgggttcaaacagttgtgctgcctcagcttcccgagtagctaggattacaggtgcatgccaccacacctggctaattttggtattttagtagagatggggtttcaccatgttggccaggctcgtctcgaactcctgacttcaggtgatccacccatctcagcctcccaaagtgctgggattacaggcgtgagccaccatgcccggcccataagtaccgttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctga

SEQ ID NO: 319922 - DNA, 2804 bp, Homo sapiens
aatcaagtctcacactgagttactaacctggtcatgagtgactgaccgtgtctgactgccactcctttttgcagggagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttgggagacgggctctcgctctgttggctcaggctggagtgcagtggcgtgatctcagctcactacagcctccacctcgtgggttcaaacagttgtgctgcctcagcttcccgagtagctaggattacaggtgcatgccaccacacctggctaattttggtattttagtagagatggggtttcaccatgttggccaggctcgtctcgaactcctgacttcaggtgatccacccatctcagcctcccaaagtgctgggattacaggcgtgagccaccatgcccggcccataagtaccgttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctga

SEQ ID NO: 319923 - DNA, 2678 bp, Homo sapiens
agcgggcggctgcggggctgccgggcagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttgggagacgggctctcgctctgttggctcaggctggagtgcagtggcgtgatctcagctcactacagcctccacctcgtgggttcaaacagttgtgctgcctcagcttcccgagtagctaggattacaggtgcatgccaccacacctggctaattttggtattttagtagagatggggtttcaccatgttggccaggctcgtctcgaactcctgacttcaggtgatccacccatctcagcctcccaaagtgctgggattacaggcgtgagccaccatgcccggcccataagtaccgttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctga

SEQ ID NO: 319924 - DNA, 1567 bp, Homo sapiens
  misc_feature (44)..(44): n is a, c, g, or t
ggaatctcagccgccgtctgagggctgaggcagcgtggggacgngtgcgcagtgcgcgggctggccgtcgcggacgccgctccgggcagccgagcctctgtgggagccggggccgcggcggcgcgggtgctccgggccgaggccgcgtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttcttta

SEQ ID NO: 319925 - DNA, 2204 bp, Homo sapiens
  misc_feature (44)..(44): n is a, c, g, or t
ggaatctcagccgccgtctgagggctgaggcagcgtggggacgngtgcgcagtgcgcgggctggccgtcgcggacgccgctccgggcagccgagcctctgtgggagccggggccgcggcggcgcgggtgctccgggccgaggccgcgtctggctcttgctgattgaattcctttggtgcagtttagcatgttcctctgtgttctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctatgcggcaggccagaaggctgtcgaacccttgtatacagaggtatacatcaagagctggtgaatgcagcacgtatgtgggctctcacgcaaacgtgccttcttagtggagggcccagacttactacttacaactgatcatagaaagttgagttaaccaaactgccttttgcagttatcataactgattttgtcaatactaacgcaaactgtttcactgtagtcatcaggttggatatgtgtatttaaaaataaaaaataaaacatacaactttactaacagaaagagacattaacatataaaaattaatatactcaactgctgcaagagtttcaattttatattatgtatttaaaaatttttaagatacaatacttacgaaatgcaccattgttctaataatatatgcaaactaatgcatgcatatgcattggataaactgtacattactatagtttgcatggcatttaaaaatctctgaaatttagccatctaataggactctgtagtgttttggtaatttgtagcactttgatttcaaagccactggtatcataaatgaatataatatactagtatatagcaatgtatttagaatggtcatatttaaggatattttcagatttgatctagttagaagcatattgaaattaacattctcaactactaattatttcaccacagtttaaaatgtgataaatgtgtaccctttgttacctttaaaatattaagccatatgaatatatgacctattcagaactaaaattaagtaaaaaatgaaaagactgtgctattattggttgcagtgaaattcagggaagtaaaaactaagtcttatcagcagaataatgtttgaaagatgattcgtgcttattaaagaaatatggcctttcattgttatagtctatattttaatttttttcattctgaaatatgtgggataattcctagtgttgactgagaatatactcttaaataaaatgatacagctgggaggttctcttttaaacacagttcagttgcagctggaacactgtatttcagtttaggttggctgaatcttcaaag

SEQ ID NO: 319926 - DNA, 1035 bp, Homo sapiens
gtacaagcccaagggagattacagggaactcttgcagcagacaagaatgagatttgttttctgaattcaacatcaactataataatgagccaccatgcccggcccataagtaccgttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctga

SEQ ID NO: 319927 - DNA, 393 bp, Homo sapiens
agggagcttactgttaatatttttattttacagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacaggtttgtaaaatcccaaggattatcttttaaaagcacagaaagttgtatttaagtatttaacatactatacaggctttagaatttgtcttcttaagcagtatatttttagatttatttctactggctgtcctctctgccctgcacccctgacctctactgttttgtttgaatttcagaaggtgaaactaagtttatttga

SEQ ID NO: 319928 - DNA, 392 bp, Homo sapiens
taagggaagtaatgagatttttcactgcttggcatgtctgattgtgggttcatatcagggtaattaagtggtgactaacatttgacattcttagaaacacaagtcttatgtctgtgttcatctctggtagatgaaaaactggaagagaagatattttcaattggatgaaaacacaataggctacttcaaatctgaactggtatgttgttacgtcataaatgttgctataagaatgtttgaaaagtgttgcaatgtagtgattatatataatttcttgtactgttctgtagtttcagaataagtctagtttttagaggtaaatatagtttatttggttgtgatgcttttggttaatgatatttttcttaaatacatttttaagtaaaaagatc

SEQ ID NO: 319929 - DNA, 428 bp, Homo sapiens
gattttgagaaaaaattgtttgaatgagttcttttttcctttaggctgatagccctgaagagatgcacagttggattaaagcagtctctggcgccattgtagcacagcggggtcccggcagatctgcgtcttctgtaggtttcctgctctctggggtgatactcccttgcgtctcccccatcctatcaaatttcctctctcccaatccatccggtttctttctttcttgagatttatttgcatgttgacttttataccaattggacttgcaaaaaataatgcatttctaatttaatgcttccttgtagtattatgtatacataactttctgtgcattgtattgtgttaaatgcacaagtagggcaactaaagaataaacatttccttgctttgttttaggagttcttacttgtcagtagctctagatt

SEQ ID NO: 319930 - DNA, 3866 bp, Homo sapiens
  misc_feature (44)..(44): n is a, c, g, or t
ggaatctcagccgccgtctgagggctgaggcagcgtggggacgngtgcgcagtgcgcgggctggccgtcgcggacgccgctccgggcagccgagcctctgtgggagccggggccgcggcggcgcgggtgctccgggccgaggccgcgtctggctcttgctgattgaattcctttggtgcagtttagcatgttcctctgtgttctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttgggagacgggctctcgctctgttggctcaggctggagtgcagtggcgtgatctcagctcactacagcctccacctcgtgggttcaaacagttgtgctgcctcagcttcccgagtagctaggattacaggtgcatgccaccacacctggctaattttggtattttagtagagatggggtttcaccatgttggccaggctcgtctcgaactcctgacttcaggtgatccacccatctcagcctcccaaagtgctgggattacaggcgtgagccaccatgcccggcccataagtaccgttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctga

SEQ ID NO: 319931 - DNA, 4046 bp, Homo sapiens
tgcccggggattcccggtggcgccggtcggagcgcctccctccagggctgtgcccgcggggcgcgcgtccccgggcatcctttcctggtgtttaatgcattttggcttcaggacttgccgaggccgaagccggctccgccctgggccctgaagtcgggcggtgtccgcgatttacctccgcaccttcggggcaggtggccagaggcagcgttgaaagcgacttgcccaaggtcacgcaggtggcaccggggaggcgaccgtctagacccaggtctttcgacgccgaggccagctgccaaccgcagagctttggggccgtcttgagtgtctggctcttgctgattgaattcctttggtgcagtttagcatgttcctctgtgttctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttgggagacgggctctcgctctgttggctcaggctggagtgcagtggcgtgatctcagctcactacagcctccacctcgtgggttcaaacagttgtgctgcctcagcttcccgagtagctaggattacaggtgcatgccaccacacctggctaattttggtattttagtagagatggggtttcaccatgttggccaggctcgtctcgaactcctgacttcaggtgatccacccatctcagcctcccaaagtgctgggattacaggcgtgagccaccatgcccggcccataagtaccgttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctga

SEQ ID NO: 319932 - DNA, 3937 bp, Homo sapiens
  misc_feature (44)..(44): n is a, c, g, or t
ggaatctcagccgccgtctgagggctgaggcagcgtggggacgngtgcgcagtgcgcgggctggccgtcgcggacgccgctccgggcagccgagcctctgtgggagccggggccgcggcggcgcgggtgctccgggccgaggccgcgtctggctcttgctgattgaattcctttggtgcagtttagcatgttcctctgtgttctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctatgcggcaggccagaaggctgtcgaacccttgtatacagaggtatacatcaagagctggtgaatgcagcacgagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttgggagacgggctctcgctctgttggctcaggctggagtgcagtggcgtgatctcagctcactacagcctccacctcgtgggttcaaacagttgtgctgcctcagcttcccgagtagctaggattacaggtgcatgccaccacacctggctaattttggtattttagtagagatggggtttcaccatgttggccaggctcgtctcgaactcctgacttcaggtgatccacccatctcagcctcccaaagtgctgggattacaggcgtgagccaccatgcccggcccataagtaccgttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctga

SEQ ID NO: 319933 - DNA, 4050 bp, Homo sapiens
  misc_feature (44)..(44): n is a, c, g, or t
ggaatctcagccgccgtctgagggctgaggcagcgtggggacgngtgcgcagtgcgcgggctggccgtcgcggacgccgctccgggcagccgagcctctgtgggagccggggccgcggcggcgcgggtgctccgggccgaggccgcgtctggctcttgctgattgaattcctttggtgcagtttagcatgttcctctgtgttctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttgggagacgggctctcgctctgttggctcaggctggagtgcagtggcgtgatctcagctcactacagcctccacctcgtgggttcaaacagttgtgctgcctcagcttcccgagtagctaggattacaggtgcatgccaccacacctggctaattttggtattttagtagagatggggtttcaccatgttggccaggctcgtctcgaactcctgacttcaggtgatccacccatctcagcctcccaaagtgctgggattacaggcgtgagccaccatgcccggcccataagtaccgttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctgaaaaaaaaaaaaaaaaaaacccaaaacaccccaaacacaaaaaaaacaaattgtgggcggcgcgcgcgccccccaaaaatttaaaacacacgggggggggcggccccagataaaccggccggtgccaagaaacccgggcaaagggggggtccccaaaaaaacgcgcggggccgggttggacaccg

SEQ ID NO: 319934 - DNA, 3610 bp, Homo sapiens
  misc_feature (1)..(1): n is a, c, g, or t
  misc_feature (12)..(12): n is a, c, g, or t
  misc_feature (18)..(18): n is a, c, g, or t
nggcccggcggncgggtngctccgggccaggcgcgtctggctcttgctgattgaattcctttggtgcagtttagcatgttcctctgtgttctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttgggagacgggctctcgctctgttggctcaggctggagtgcagtggcgtgatctcagctcactacagcctccacctcgtgggttcaaacagttgtgctgcctcagcttcccgagtagctaggattacaggtgcatgccaccacacctggctaattttggtattttagtagagatggggtttcaccatgttggccaggctcgtctcgaactcctgacttcaggtgatccacccatctcagcctcccaaagtgctgggattacaggcgtgagccaccatgcccggcccataagtaccgttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctga

SEQ ID NO: 319935 - DNA, 1637 bp, Homo sapiens
  misc_feature (44)..(44): n is a, c, g, or t
ggaatctcagccgccgtctgagggctgaggcagcgtggggacgngtgcgcagtgcgcgggctggccgtcgcggacgccgctccgggcagccgagcctctgtgggagccggggccgcggcggcgcgggtgctccgggccgaggccgcgtctggctcttgctgattgaattcctttggtgcagtttagcatgttcctctgtgttctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttcttta

SEQ ID NO: 319936 - DNA, 2111 bp, Homo sapiens
  misc_feature (44)..(44): n is a, c, g, or t
ggaatctcagccgccgtctgagggctgaggcagcgtggggacgngtgcgcagtgcgcgggctggccgtcgcggacgccgctccgggcagccgagcctctgtgggagccggggccgcggcggcgcgggtgctccgggccgaggccgcgtctggctcttgctgattgaattcctttggtgcagtttagcatgttcctctgtgttctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctatgcggcaggccagaaggctgtcgaacccttgtatacagaggtatacatcaagagctggtgaatgcagcacgtatgtgggctctcacgcaaacgtgccttcttagtggagggcccagacttactacttacaactgatcatagaaagttgagttaaccaaactgccttttgcagttatcataactgattttgtcaatactaacgcaaactgtttcactgtagtcatcaggttggatatgtgtatttaaaaataaaaaataaaacatacaactttactaacagaaagagacattaacatataaaaattaatatactcaactgctgcaagagtttcaattttatattatgtatttaaaaatttttaagatacaatacttacgaaatgcaccattgttctaataatatatgcaaactaatgcatgcatatgcattggataaactgtacattactatagtttgcatggcatttaaaaatctctgaaatttagccatctaataggactctgtagtgttttggtaatttgtagcactttgatttcaaagccactggtatcataaatgaatataatatactagtatatagcaatgtatttagaatggtcatatttaaggatattttcagatttgatctagttagaagcatattgaaattaacattctcaactactaattatttcaccacagtttaaaatgtgataaatgtgtaccctttgttacctttaaaatattaagccatatgaatatatgacctattcagaactaaaattaagtaaaaaatgaaaagactgtgctattattggttgcagtgaaattcagggaagtaaaaactaagtcttatcagcagaataatgtttgaaagatgattcgtgcttattaaagaaatatggcctttcattgttatagtctatattttaatttttttcattctgaaatatgtgggataacacgttcgcgaggggatcctctcagagtcgc

SEQ ID NO: 319937 - DNA, 524 bp, Homo sapiens
atccattcatttccctatggaaaacaatgatttaatctaaacagcaacaaggttctcaaaaatattccagaagtttcatcttcacaaattactggaaaacataattattattctgccacatttacctttgaaaacagaaaaaaaaagacaacagaaaatctgaatgaattataatagcaaacaagatgccaaactccacactaaaaattacagtatgcccaattcaactgaggagtagtgacataattaccttagtgctccacaacacagatggatgcactttttcttaatctattttattaaaactgcaacctagaacaacttattaaatacacactaggcaatagtgcaaacataaacaaatgcatttatttcactgatacgtgcaatgctgcttttttgcaaagggcgtatattatcacaaaacatttgccatctatgataacaatagctgccatgaacctaggagaaaagtgaaaaaagttagcatctgttatgcctgtatttaagacttaatgaggcca

SEQ ID NO: 319938 - DNA, 5093 bp, Homo sapiens
ttcacattaaaatattttatagcctcctgtactggtaagtagtgggattgcacctgtgaatagactctgcactcaagcctgagcaacatagtgagaccctgtccctaaataataataataatattttatagccattatggatgaggattgctcagtaatagatggccagttgttcagtagttaaaaatgaaccttggctttaaggaaatttataagaaaacatggtaagactaccactatataacatcacattctaaacagaatttatgtcccatgtattgacctttaagtttttaacattaaaccgtaagtagctattttaagaaaatttaagagtttgttttgatttgaaaaattaaattattttaaaattagctaagaccattttaaaataaattatcttaaaattatagataatttattcaaacaaaaacaaattgtcaaaaccaaattgattaccctttctcaacaaaatctcagcatcttcctcaaattcactcttcccccaaatctcactattctagcaaattcctccactttcctgtaaagtcataatcaatgaactatacccccaatgttaattgatatatttaaccatatcttttgctccttggttcttctgatctgtagtttactctccaccctgttgttcccggccttgtctaacttgaaaaataattttcaaattccctttcttttctgtacacactctctatgtaggatttgtttgtatgtttgtttgtttttaaccttcctggcattcttggatggcctttgagtctgtgaactctgccgaaattgagtatacaattttgtatctgtggacattttgctggaaagaagttctgtgttttctttaggttgaagagtctataaaccaacccccctcgccccgtgccacaactccaaaaactgaaaagataagcactgccttgatgatccgtatggggaactaagtacccttagaaagaggccctcagaagagtcttctcttaagaagataaagaaggtagtggaaacgaacttcctgagcttttcaggctctaatggctgaagaatcaagaaagccttcagccccatccccaccagaccagactcctgaagaggatcttgtaatcgtcaaggtagaggaggatcatggttgggaccaggaatctagtctgcatgaaagtaaccctcttggccaagaagtgttccgcctgcgcttcaggcagttacgctaccaggagacactaggaccccgagaagctctgatccaactacgggccctttgccatcagtggctgaggccagatttgaacaccaaggaacagatcctggagctgctggtgctggagcagttcttgaccatcctacctgaggagctccagacactggttaaggaacatcagctagagaacggagaggaggtggtgaccctattagaggatttggaaaggcagattgatatactaggacgaccagtctcagctcgcgtacatggacatagggtactctgggaggaggtagtacattcagcatctgcaccagagcctccaaatactcagctccaatctgaggcaacccaacataaatctccagtgccccaagagtcacaagagagagccatgtctacttcccagagtcctactcgttcccagaaaggaagttctggagaccaggaaatgacagctacacttctcacagcagggttccagactttggagaagattgaagacatggctgtgtcccttattcgagaggagtggcttcttgatccatcacagaaggatctgtgtagagataacaggccagaaaatttcagaaacatgttctccctgggtggtgagaccaggagtgagaacagggaattagcttcaaaacaggtaatatctactggaatccagccacatggagagacagctgccaaatgcaacggggatgttatcaggggtcttgagcatgaagaagcccgagaccttctgggcagattagagaggcagcggggaaatcccacacaagagagacgacataaatgtgatgaatgtgggaaaagctttgctcagagctcaggccttgttcgccactggagaatccacactggggagaaaccctatcagtgtaatgtgtgtggtaaagccttcagttacaggtcagcccttctttcacatcaggatatccacaacaaagtaaaacgctatcactgtaaggagtgtggcaaagccttcagtcagaacacaggcctgattctgcaccagagaatccacactggggagaagccatatcagtgcaatcagtgtgggaaggctttcagtcagagtgcgggccttattctgcaccagagaatccacagtggagagagaccctatgaatgtaatgagtgtgggaaagctttcagtcatagctcacacctcattggacatcagagaatccacactggggagaagccctatgagtgtgatgagtgtgggaaaaccttcaggcggagctcacatcttattggtcatcagaggagccacactggggagaaaccctacaaatgcaatgagtgtgggagggccttcagtcagaagtcaggccttattgaacatcagagaatccacactggagaaagaccctataaatgtaaagaatgtgggaaagctttcaatgggaacactggtctcattcaacacctgagaattcacacaggggagaagccctaccaatgtaatgagtgtgggaaagcctttattcagaggtcaagtctcattcgacatcagagaatccacagtggtgaaaaatctgaatccataagcgtttaggaacaacatcagttagagtttgagcattattcagcattagggaaaccacacactggtgagaggtctttcagtgtactaaaaggcagaaaggtcatcacaactttagtgtcagaatctatagtggtggcaaagttaggatagctctttagtaatttgggcccagtgccttggtgaaggttgattaccttgactgtctttgaaagtatctgatggagctcctgatgacctaatgtatcctttagaaatttaaaatagcattagagcaagttgcttgtcatggcttgaagagcttaactttgtcttttgggtgagtagctataggtttgagagaggctggctactcctagttcctgtgcttcttcccatctcctgtgatccccctctcccatttattcccttgaaggtgcccttgtattcctaatctgatctaagaagctgctgtagagtcagaagtagcttctgtgtgaaacttatatttgtatgtagctttctaggaaaattttacagacacttaaagtatttatgcttaagtgtgcatttttttattctaatattccttctagtcagtggaaatttgtattcccatacaaactcagaatgctatatttttaacagcactccagcatttttcttcatgtatcaccttcactgactccattgagtcattgagcatctgtacatatccttcaccacccccagtcccagcacctgtgtcagtaaagaaagtggacacattagtaatggttatgggagtaatacagagaaagaggtgagtggagactcagcccagctgctcttgagcttggatagttatacattttggtgacttctgactctccttccacctccccactgtacactgtggtacagatagttggcactatcctagttatggcatcaggtaggagaaggagacgaagatgctttaggaagataaaaaccttacaaagaatgtatactcatcttttttggcccattacaatactgctttctcaggttcttaacagcctgtgcaaactccctgactagatggtctgtcactcctatcattaaccttgcacccatctctttagatggcctcagcacctcactcgttattctccatctgtttcttgccattagtttatatgactttaatatccacagtggtaatgtaataccttacctcacaggttttcattcttttgaactctggtgcactccatctgtaatccatgtctataatctaccaacaaagatgtactcttaaactcagtatcaccaggcactatatttcatctttgaggcttttgttataccaaggaatactatataaagtaatgagactggtttaaagtaacatgccagaacttacgcatccaatgtgggttgtcacttgttattcccaagtactattattccatactactatattcttccaaatatttggaacactcttagaattcccatttaataaaccatatgagaaaaccctctattactcttacactttagttttaccatttgagtagccacttattcaccagagttggaattgagaaattttgggctttccaaaattaacctttaaacttaaaattgattacattgagcctattcagaaaaaaaattatataggttctgatgaaagcttcataatttcaccctgtgactatcctgaaaagaaataataatcattttatgattgatgggccaaaaaaagcaatcaaagtcttacgtcatagaggaccaccttttggatcataaattctttccctataacattccttctctgcctctctatggcccactttgaccactaacaacatcagaattatctacatcaatttcattgagccattggtgaatgaagacacccatcacttgtcatgttggtttccaacagtcctttcgattatcctttattttcttatcctcccttctcttgtttcttttatttataagttaccattcctagtttctttgtacttgaaattttaagaaaccagaaacaagtaaatctggttgtatctagatctttgctctgtgtttcagttgtgccttaccctctgtaagatactgattcttcctggggccagtattaccttgtatgcaaatattacatatgatgggtgcattgtcagagggaaaatatatgtgtatgtacacatgtgtatgtacacacacacacacacctgccatacactttagaagaacgcttctcttctattccaataaaaagtccttttagcaatgcaacatattaacaaaattgggtgcattcagggtggtatggccatagaccagagcaacacaccatgaaatgtatac

SEQ ID NO: 319939 - DNA, 369 bp, Homo sapiens
tctgtgaactctgccgaaattgagtatacaattttgtatctgtggacattttgctggaaagaagttctgtgttttctttaggttgaagagtctataaaccaacccccctcgccccgtgccacaactccaaaaactgaaaagataagcactgccttgatgatccgtatggggaactgtatgtacagtaatctgatttttttcctaagtacctatctcttctttgtggactataggtctctggttttatcttgatgttagcatctcatgacaactggtttagggtatgctacctttacttacactcttcttcattctctacagtatctttgaaatacaaagataatggtcacctctgtcaacaaacatttg

SEQ ID NO: 319940 - DNA, 4231 bp, Homo sapiens
gctttcatcgcctttactccccgaccttccttcgagtctgtttatccgttgcagcctcccttccccacgacggggcgcctctgcaactcacaaagtacccttagaaagaggccctcagaagagtcttctcttaagaagataaagaaggtagtggaaacgaacttcctgagcttttcaggctctaatggctgaagaatcaagaaagccttcagccccatccccaccagaccagactcctgaagaggatcttgtaatcgtcaaggtagaggaggatcatggttgggaccaggaatctagtctgcatgaaagtaaccctcttggccaagaagtgttccgcctgcgcttcaggcagttacgctaccaggagacactaggaccccgagaagctctgatccaactacgggccctttgccatcagtggctgaggccagatttgaacaccaaggaacagatcctggagctgctggtgctggagcagttcttgaccatcctacctgaggagctccagacactggttaaggaacatcagctagagaacggagaggaggtggtgaccctattagaggatttggaaaggcagattgatatactaggacgaccagtctcagctcgcgtacatggacatagggtactctgggaggaggtagtacattcagcatctgcaccagagcctccaaatactcagctccaatctgaggcaacccaacataaatctccagtgccccaagagtcacaagagagagccatgtctacttcccagagtcctactcgttcccagaaaggaagttctggagaccaggaaatgacagctacacttctcacagcagggttccagactttggagaagattgaagacatggctgtgtcccttattcgagaggagtggcttcttgatccatcacagaaggatctgtgtagagataacaggccagaaaatttcagaaacatgttctccctgggtggtgagaccaggagtgagaacagggaattagcttcaaaacaggtaatatctactggaatccagccacatggagagacagctgccaaatgcaacggggatgttatcaggggtcttgagcatgaagaagcccgagaccttctgggcagattagagaggcagcggggaaatcccacacaagagagacgacataaatgtgatgaatgtgggaaaagctttgctcagagctcaggccttgttcgccactggagaatccacactggggagaaaccctatcagtgtaatgtgtgtggtaaagccttcagttacaggtcagcccttctttcacatcaggatatccacaacaaagtaaaacgctatcactgtaaggagtgtggcaaagccttcagtcagaacacaggcctgattctgcaccagagaatccacactggggagaagccatatcagtgcaatcagtgtgggaaggctttcagtcagagtgcgggccttattctgcaccagagaatccacagtggagagagaccctatgaatgtaatgagtgtgggaaagctttcagtcatagctcacacctcattggacatcagagaatccacactggggagaagccctatgagtgtgatgagtgtgggaaaaccttcaggcggagctcacatcttattggtcatcagaggagccacactggggagaaaccctacaaatgcaatgagtgtgggagggccttcagtcagaagtcaggccttattgaacatcagagaatccacactggagaaagaccctataaatgtaaagaatgtgggaaagctttcaatgggaacactggtctcattcaacacctgagaattcacacaggggagaagccctaccaatgtaatgagtgtgggaaagcctttattcagaggtcaagtctcattcgacatcagagaatccacagtggtgaaaaatctgaatccataagcgtttaggaacaacatcagttagagtttgagcattattcagcattagggaaaccacacactggtgagaggtctttcagtgtactaaaaggcagaaaggtcatcacaactttagtgtcagaatctatagtggtggcaaagttaggatagctctttagtaatttgggcccagtgccttggtgaaggttgattaccttgactgtctttgaaagtatctgatggagctcctgatgacctaatgtatcctttagaaatttaaaatagcattagagcaagttgcttgtcatggcttgaagagcttaactttgtcttttgggtgagtagctataggtttgagagaggctggctactcctagttcctgtgcttcttcccatctcctgtgatccccctctcccatttattcccttgaaggtgcccttgtattcctaatctgatctaagaagctgctgtagagtcagaagtagcttctgtgtgaaacttatatttgtatgtagctttctaggaaaattttacagacacttaaagtatttatgcttaagtgtgcatttttttattctaatattccttctagtcagtggaaatttgtattcccatacaaactcagaatgctatatttttaacagcactccagcatttttcttcatgtatcaccttcactgactccattgagtcattgagcatctgtacatatccttcaccacccccagtcccagcacctgtgtcagtaaagaaagtggacacattagtaatggttatgggagtaatacagagaaagaggtgagtggagactcagcccagctgctcttgagcttggatagttatacattttggtgacttctgactctccttccacctccccactgtacactgtggtacagatagttggcactatcctagttatggcatcaggtaggagaaggagacgaagatgctttaggaagataaaaaccttacaaagaatgtatactcatcttttttggcccattacaatactgctttctcaggttcttaacagcctgtgcaaactccctgactagatggtctgtcactcctatcattaaccttgcacccatctctttagatggcctcagcacctcactcgttattctccatctgtttcttgccattagtttatatgactttaatatccacagtggtaatgtaataccttacctcacaggttttcattcttttgaactctggtgcactccatctgtaatccatgtctataatctaccaacaaagatgtactcttaaactcagtatcaccaggcactatatttcatctttgaggcttttgttataccaaggaatactatataaagtaatgagactggtttaaagtaacatgccagaacttacgcatccaatgtgggttgtcacttgttattcccaagtactattattccatactactatattcttccaaatatttggaacactcttagaattcccatttaataaaccatatgagaaaaccctctattactcttacactttagttttaccatttgagtagccacttattcaccagagttggaattgagaaattttgggctttccaaaattaacctttaaacttaaaattgattacattgagcctattcagaaaaaaaattatataggttctgatgaaagcttcataatttcaccctgtgactatcctgaaaagaaataataatcattttatgattgatgggccaaaaaaagcaatcaaagtcttacgtcatagaggaccaccttttggatcataaattctttccctataacattccttctctgcctctctatggcccactttgaccactaacaacatcagaattatctacatcaatttcattgagccattggtgaatgaagacacccatcacttgtcatgttggtttccaacagtcctttcgattatcctttattttcttatcctcccttctcttgtttcttttatttataagttaccattcctagtttctttgtacttgaaattttaagaaaccagaaacaagtaaatctggttgtatctagatctttgctctgtgtttcagttgtgccttaccctctgtaagatactgattcttcctggggccagtattaccttgtatgcaaatattacatatgatgggtgcattgtcagagggaaaatatatgtgtatgtacacatgtgtatgtacacacacacacacacctgccatacactttagaagaacgcttctcttctattccaataaaaagtccttttagcaatgcaacatattaacaaaattgggtgcattcagggtggtatggccatagaccagagcaacacaccatgaaatgtatac

SEQ ID NO: 319941 - DNA, 598 bp, Homo sapiens
gtgtcagaaacatttaaataagataaacataaaattgtccatagcaattatctctaggaagagagactgcaagaatggaaaatgaaagtaatatggggaagggcttttgcctatgtgtgcatgtgtgcgtgtgtgtgtatgtgtgtgtgctggggtttttgtaataacaaaaattccttaaaaggcattcaaagtctgatcagacttaatttttatctgcatccatgagcttggcataaggattacacatttcattatctaataaaggggacaccattaaggaaaagagcaacattctctctgcccctttggcctctccaattgaactaaaacaagacttattaagtttttacccactccaaaacaaatgtttccatttcatcagaagcaagagagaaaaatcttaaaggacattaaccttcaagcagctccgaagggaaaggaatattagaacttgagaaataaaatggagaatgaaactcccttgacactcttcaggtaacaaggagaaccacacagttaaagagctattccctcctcatagtgaaaccctgaggtggaaactgatgaaaagtgtcccagagagcagcctgctcgc

SEQ ID NO: 319942 - DNA, 405 bp, Homo sapiens
agaggcagacacagatagacagagagagagaaaatgaattagtgatgtgctggcgtccactgacatctaaccatgtaagtcaatttagccatgataggagtatagttacaccatgaaaatcacaacaccacacacacacgtgcacacacacacataaatcaggtttatttgtttttcagagagtttgttgctaaacatttaccagcacaccctaaagagaggagaaaaaaaatatgtgaagaaaaagaaaaaaggagaaatcaaagaaagagaaagcaaaaagagcatatttggatgtggaagaagaaaaagacaagttgaactgtcttaaattccagcccatgaaagccttcctttttttaaataaagtttttgttttgttttggtctggaatgtttttctttt

SEQ ID NO: 319943 - DNA, 3419 bp, Homo sapiens
cgtgcctcggtttccgttagcaaccagaggcttctaaacaacctaccctccttccccattttctgtggtccaactaccctcggcgatcccaggcttggcggggcaccgcctggcctctcccgttcctttaggctgccgccgctgcctgccgccatggcagagttgggcctaaatgagcaccatcaaaatgaagttattaattatatgcgttttgctcgttcaaagagaggcttgagactcaaaactgtagattcctgcttccaagacctcaaggagagcaggctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagaccattgaaatacaggctacaaatgcactggatgaaaagtcaaaactagaaaaagcactgcaagatttacagcttgatcaaggaaatcaaaaggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaaggaattagaaaagaaatttcagcaaacagcagcttatcgaaacatgaaagagattcttaccaagaagaatgaccaaatcaaagatctgaggaaaagactggcacaatatgaacctgaagattaaaactgaagatttcctctggaagctaccacatgcaaacatacaagcagtctcacctcaggcatgtattttgaaaagcattttgtcatatcccctctccttatttttctaatatttagactttgaatatttagaactagagttcctattttcagctagttgaaaacagagaaaacctagtgattctgtctggtcatcccacacacctctctactgagtgctccagagtcttagctcacatgcactgagaattctttacagcaaagaagagatttttagagtgggaagaagaggcttatccttctgcattagtataaagagtctgtatttttaataaatgttaaataagctaacaatgtttgtacttatgcattccccatgggtaaaaataaataatagcattgttaaagatagttattaccaaaaaaagagagttattacaaataaatatgtctctttatttttaaaaatgaaatcttaattcatttactctatttgatgataaactataaattcattgaaaatgtgaattctattatgggtagcctttttaccaattataaggaaaatttacagcagtgaacatgaacattcacttagcttcctcagtctctccatcttaaagatcatttatcagaggaggttcagcattttttgcagcataacttttcatgagtctgtattactaatggataagtcaaatccatcctgcacttctacagtttagaaagtatctggactcagaataaatgtaatatttatacttgtttccagaatgttattttacattttatgttcaataagaacactttttaaaagacgtatattcaacataaaatcagctatcagacttcagattagactttatttatgtgggtctataataattgtattttcaagaggttttcactatatttgtattggcctggttttctcagacgattttggacaaatcattagaaactgggcatcatatccacagttatgtaaggcagtgatatactataaggataaacaaagtcaagtccataaagcaataatccctcagaaggaaagtccttacttttcacatattaatatttagtaatttttcctgcttctaaaagtgagagtatcacaccctaaatgaacactgtctactaagagacatcattccatttccacaaatgaagattttattccaagaaacgagtttactgattggagcatagggcttgttgttatttttattcaagcttttagtaatagccttgaatttattatttttcttataggctttttgttaaaatagtgaaggaacaaatgttaaagggtaagataatttccctgcaaaaggacacagaaggcagtcttaagaagatgaatggatgagagaagggagagaataaaatgcaataacgagccagcatttactatgtattttctcctcacctgtctctccatatttaggtcacttaccagtttctgtgcccttttggagcttttgttgagggcttcattctcaccctgtatttctttagccctaaattgacactctctccaaaaatccattccattgtctgtggaccaagatgttctatgtaattcagaagcagaactcttggctaaagggctagtgtggccttcagaaaccattcaattattttctccctacacctttgtcagtttgaaaccagtgaggaaaaaaggtatgttgataagaaacctatattgctaggtagaatttgtacttgttttcttggtagcagttttgaaatattctgtacagtacgttcctattgtttaataataaattcaaaaatatttctaaaaccttaaaaccaactatgccaagcattaagataaacaaatatgatgttctttgacgtaaatcaacgtgatgattctttcacatgtaaacacattttagtgtttctggtttgtcatttttgttgttgttgttgttgttgttatttactctataccctttagcaaaatacagttttaaatttttattgtttttagtagtttcccaactttaagacttatctaatttaactgagaaagaaagcctttttcatatatatatatattggatttctaaggatggtggtttgagccttgattagacttttgatgtgctaagccagacaggcagtctgtacattgatggccatcacaatgcagctttggtttaatttaattcaggcctgctgctgagttatgcacagactttttgttgaccaaaataaaatataaagggttttcttctgtttgacatttgtgttcattttttctctttatgtattacattttaacctatattaaataaatgtttaaatgataatttgcttatgtcttataaaactcagcataagaaaaaaaaaact

SEQ ID NO: 319944 - DNA, 3375 bp, Homo sapiens
cgtgcctcggtttccgttagcaaccagaggcttctaaacaacctaccctccttccccattttctgtggtccaactaccctcggcgatcccaggcttggcggggcaccgcctggcctctcccgttcctttaggctgccgccgctgcctgccgccatggcagagttgggcctaaatgagcaccatcaaaatgaagttattaattatatgcgttttgctcgttcaaagagaggcttgagactcaaaactgtagattcctgcttccaagacctcaaggagagcaggctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagaccattgaaatacaggctacaaatgcactggatgaaaagtcaaaactagaaaaagcactgcaagatttacagcttgatcaaggaaatcaaaaggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaaggaattagaaaagaaatttcagcaaacagcagcttatcgaaacatgaaagagattcttaccaagaagaatgaccaaatcaaagatctgaggaaaagactggcacaatatgaacctgaagattaaaactgaagatttcctctggaagctaccacatgcaaacatacaagcagtctcacctcaggcatgtattttgaaaagcattttgtcatatcccctctccttatttttctaatatttagactttgaatatttagaactagagttcctattttcagctagttgaaaacagagaaaacctagtgattctgtctggtcatcccacacacctctctactgagtgctccagagtcttagctcacatgcactgagaattctttacagcaaagaagagatttttagagtgggaagaagaggcttatccttctgcattagtataaagagtctgtatttttaataaatgttaaataagctaacaatgtttgtacttatgcattccccatgggtaaaaataaataatagcattgttaaagatagttattaccaaaaaaagagagttattacaaataaatatgtctctttatttttaaaaatgaaatcttaattcatttactctatttgatgataaactataaattcattgaaaatgtgaattctattatgggtagcctttttaccaattataaggaaaatttacagcagtgaacatgaacattcacttagcttcctcagtctctccatcttaaagatcatttatcagaggaggttcagcattttttgcagcataacttttcatgagtctgtattactaatggataagtcaaatccatcctgcacttctacagtttagaaagtatctggactcagaataaatgtaatatttatacttgtttccagaatgttattttacattttatgttcaataagaacactttttaaaagacgtatattcaacataaaatcagctatcagacttcagattagactttatttatgtgggtctataataattgtattttcaagaggttttcactatatttgtattggcctggttttctcagacgattttggacaaatcattagaaactgggcatcatatccacagttatgtaaggcagtgatatactataaggataaacaaagtcaagtccataaagcaataatccctcagaaggaaagtccttacttttcacatattaatatttagtaatttttcctgcttctaaaagtgagagtatcacaccctaaatgaacactgtctactaagagacatcattccatttccacaaatgaagattttattccaagaaacgagtttactgattggagcatagggcttgttgttatttttattcaagcttttagtaatagccttgaatttattatttttcttataggctttttgttaaaatagtgaaggaacaaatgttaaagggtaagataatttccctgcaaaaggacacagaaggcagtcttaagaagatgaatggatgagagaagggagagaataaaatgcaataacgagccagcatttactatgtattttctcctcacctgtctctccatatttaggtcacttaccagtttctgtgcccttttggagcttttgttgagggcttcattctcaccctgtatttctttagccctaaattgacactctctccaaaaatccattccattgtctgtggaccaagatgttctatgtaattcagaagcagaactcttggctaaagggctagtgtggccttcagaaaccattcaattattttctccctacacctttgtcagtttgaaaccagtgaggaaaaaaggtatgttgataagaaacctatattgctaggtagaatttgtacttgttttcttggtagcagttttgaaatattctgtacagtacgttcctattgtttaataataaattcaaaaatatttctaaaaccttaaaaccaactatgccaagcattaagataaacaaatatgatgttctttgacgtaaatcaacgtgatgattctttcacatgtaaacacattttagtgtttctggtttgtcatttttgttgttgttgttgttgttgttatttactctataccctttagcaaaatacagttttaaatttttattgtttttagtagtttcccaactttaagacttatctaatttaactgagaaagaaagcctttttcatatatatatatattggatttctaaggatggtggtttgagccttgattagacttttgatgtgctaagccagacaggcagtctgtacattgatggccatcacaatgcagctttggtttaatttaattcaggcctgctgctgagttatgcacagactttttgttgaccaaaataaaatataaagggttttcttctgtttgacatttgtgttcattttttctctttatgtattacattttaacctatattaaataaatgtttaaatgata

SEQ ID NO: 319945 - DNA, 2286 bp, Homo sapiens
  misc_feature (48)..(48): n is a, c, g, or t
gaagcggccggcctactaaataattataataaacgcgcgggttcgganctccttccttaattttttcaaaaaattaaagttttttgaatatttagaactagagttcctattttcagctagttgaaaacagagaaaacctagtgattctgtctggtcatcccacacacctctctactgagtgctccagagtcttagctcacatgcactgagaattctttacagcaaagaagagatttttagagtgggaagaagaggcttatccttctgcattagtataaagagtctgtatttttaataaatgttaaataagctaacaatgtttgtacttatgcattccccatgggtaaaaataaataatagcattgttaaagatagttattaccaaaaaaagagagttattacaaataaatatgtctctttatttttaaaaatgaaatcttaattcatttactctatttgatgataaactataaattcattgaaaatgtgaattctattatgggtagcctttttaccaattataaggaaaatttacagcagtgaacatgaacattcacttagcttcctcagtctctccatcttaaagatcatttatcagaggaggttcagcattttttgcagcataacttttcatgagtctgtattactaatggataagtcaaatccatcctgcacttctacagtttagaaagtatctggactcagaataaatgtaatatttatacttgtttccagaatgttattttacattttatgttcaataagaacactttttaaaagacgtatattcaacataaaatcagctatcagacttcagattagactttatttatgtgggtctataataattgtattttcaagaggttttcactatatttgtattggcctggttttctcagacgattttggacaaatcattagaaactgggcatcatatccacagttatgtaaggcagtgatatactataaggataaacaaagtcaagtccataaagcaataatccctcagaaggaaagtccttacttttcacatattaatatttagtaatttttcctgcttctaaaagtgagagtatcacaccctaaatgaacactgtctactaagagacatcattccatttccacaaatgaagattttattccaagaaacgagtttactgattggagcatagggcttgttgttatttttattcaagcttttagtaatagccttgaatttattatttttcttataggctttttgttaaaatagtgaaggaacaaatgttaaagggtaagataatttccctgcaaaaggacacagaaggcagtcttaagaagatgaatggatgagagaagggagagaataaaatgcaataacgagccagcatttactatgtattttctcctcacctgtctctccatatttaggtcacttaccagtttctgtgcccttttggagcttttgttgagggcttcattctcaccctgtatttctttagccctaaattgacactctctccaaaaatccattccattgtctgtggaccaagatgttctatgtaattcagaagcagaactcttggctaaagggctagtgtggccttcagaaaccattcaattattttctccctacacctttgtcagtttgaaaccagtgaggaaaaaaggtatgttgataagaaacctatattgctaggtagaatttgtacttgttttcttggtagcagttttgaaatattctgtacagtacgttcctattgtttaataataaattcaaaaatatttctaaaaccttaaaaccaactatgccaagcattaagataaacaaatatgatgttctttgacgtaaatcaacgtgatgattctttcacatgtaaacacattttagtgtttctggtttgtcatttttgttgttgttgttgttgttgttatttactctataccctttagcaaaatacagttttaaatttttattgtttttagtagtttcccaactttaagacttatctaatttaactgagaaagaaagcctttttcatatatatatatattggatttctaaggatggtggtttgagccttgattagacttttgatgtgctaagccagacaggcagtctgtacattgatggccatcacaatgcagctttggtttaatttaattcaggcctgctgctgagttatgcacagactttttgttgaccaaaataaaatataaagggttttcttctgtttgacatttgtgttcattttttctctttatgtattacattttaacctatattaaataaatgtttaaatgata

SEQ ID NO: 319946 - DNA, 1262 bp, Homo sapiens
cgtgcctcggtttccgttagcaaccagaggcttctaaacaacctaccctccttccccattttctgtggtccaactaccctcggcgatcccaggcttggcggggcaccgcctggcctctcccgttcctttaggctgccgccgctgcctgccgccatggcagagttgggcctaaatgagcaccatcaaaatgaagttattaattatatgcgttttgctcgttcaaagagaggcttgagactcaaaactgtagattcctgcttccaagacctcaaggagagcaggctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagaccattgaaatacaggctacaaatgcactggatgaaaagtcaaaactagaaaaagcactgcaagatttacagcttgatcaaggaaatcaaaaggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaaggaattagaaaagaaatttcagcaaacagcagcttatcgaaacatgaaagagattcttaccaagaagaatgaccaaatcaaagatctgaggaaaagactggcacagtaagccacactgatcccgcctttggatttctctctctggattgatgtttgttctctgttaaatctaagcttgttccagagaggtcaagccggtggtagttgctggatcatttagtccagaagccttcatttgaggaaagtggaggagctctggcctgaccttatctataatgcccaccagggcttctttttaggttcatctaggcctttagactcacacaggcctac

SEQ ID NO: 319947 - DNA, 841 bp, Homo sapiens
  misc_feature (763)..(763): n is a, c, g, or t
cgtgcctcggtttccgttagcaaccagaggcttctaaacaacctaccctccttccccattttctgtggtccaactaccctcggcgatcccaggcttggcggggcaccgcctggcctctcccgttcctttaggctgccgccgctgcctgccgccatggcagagttgggcctaaatgagcaccatcaaaatgaagttattaattatatgcgttttgctcgttcaaagagaggcttgagactcaaaactgtagattcctgcttccaagacctcaaggagagcaggctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagaccattgaaatacaggctacaaatgcactggatgaaaagtcaaaactagaaaaagcactgcaagatttacagcttgatcaaggaaatcaaaaggttttataanggccagacttagtaattagaaacatggggtgcttaagaggggttcgaagacttatgacagacgccggcctgggggtgg

SEQ ID NO: 319948 - DNA, 546 bp, Homo sapiens
tgaaattacatgcatgcatttatttttcataggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaaggtcagaagaccatgtttaagggatttgtctgttaatgcatgattaatgcacacagtatagaggaatacatgtggctaagataaacgttggacaactgcaaattcagattattttttctcaaggtattagccaatatgttctaaagattaatcatttccgggcactgatattcttccatctttggtactaaaatatctgtgataataagacatctcctctccctctatggtgtagtgaaatgctcctctgtaggtggcttgaatcctgccctacatcccaccatgttgctcttctgctccttcttcccacagcctgcagagggatgagggactgtttt

SEQ ID NO: 319949 - DNA, 2371 bp, Homo sapiens
  misc_feature (915)..(915): n is a, c, g, or t
  misc_feature (991)..(991): n is a, c, g, or t
  misc_feature (1035)..(1035): n is a, c, g, or t
  misc_feature (1763)..(1763): n is a, c, g, or t
  misc_feature (1938)..(1938): n is a, c, g, or t
cgtgcctcggtttccgttagcaaccagaggcttctaaacaacctaccctccttccccattttctgtggtccaactaccctcggcgatcccaggcttggcggggcaccgcctggcctctcccgttcctttaggctgccgccgctgcctgccgccatggcagagttgggcctaaatgagcaccatcaaaatgaagttattaattatatgcgttttgctcgttcaaagagaggcttgagactcaaaactgtagattcctgcttccaagacctcaaggagagcaggctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccggtaataaaatttgaacttgcaactgtgacaataatggcccaagcataatcttaaaagttagtgaacatctttggctgcatattttcttggggctagtgtgtgaggaaatttgggtagggtaacagcaaagcattgagtcactgagtgatctcttgggtaccactaagcacccttttaaaagttctctgtttctactgttcctaggtattacaaaggccatcgagatttatgaaattgcttttcaggctatcattaattatttcttacagcatttttgttagcttggtcagtattaccatcagtctttatagattggtcaactaagaaatagagattatgagacagttgaaaagtcaattcaaatataataaataccatcaattcaatccagtagcattggaagttttctaaataatggaatttaaaagtatacatttantaactttgaaataggaaatatacaaaaaagcttataatatggacatctaagagctcaaattcaaaaaatatggtanaattggtgaagttgaaactcattttaagaaaaagcatgccaganatcaggaaggactgaccgccaagccccgtgaactactctaagcacagtcacagcacatcagttcacatgcagagtgttgaacaacgctgaggacaacctatgagctggggaggaaaatcattgaacttctgccactgtcagtagatgactggtgagaaaactctgagaaggtggtgctttaagaagcttagaagctgactgctgttaacactctaagcttgtgtgtagtcacttctcattggcctttgcaaatcttcagatggcacacccccactatctgtctttcctaggaatttgtggtactctttttcagtagatactatggactattttcatttttctgagactactttattaagaatcttttttgaacacctactagctaacaatacacattatgtaataaaacagtctcctcatagcacctcaagaatacaaagttgactataaattttcctcatatttgtattaacattatggtttatttctagcagtagatattgcatacctagtagatacaaaatgccaggtactgtggatgattacatttgagtccatgtggtttaggttctcaaccatttgcaactaacatttttgatatggtgaagtttggtccatcttgctctgttctctctggcatgtaatgggttggtaccagtgattttactcttcttgcgtgtgatataaatctattttaaatgaataatttttatctttgctttcttctncaagagaattattagaacaagttgcagaatttgaaaaagcagagattacatcttcaaacaaaaagcccatcttagatgtcacaaagccaaaacttgctccacttaatgaaggtggaacagcagaactcctaaacaaggtaatattattattttgagaaacggaaagtctctcatnctgtcctgtcattgcctagggtggagaaacagaagtggaaggtttgtttcaggtcctctgaggataattagtccattgcagtagttttacttgatggtaccccatgggccagaagagggcatacttaaccttctagagagcctgaagtagctcctgatcacaccttttcaaggtaaagtgaagagcatgaaattttggacagcgtttattgatggacatttaaagtttgtgatctgcggtaacaaggagaagggtttttaagtttataaaaattatttatcaattagccgggtgtggtggtacgtgcctatagtcagagctactcgggaggctgaggcaggagaattgcttgaacccgggaggtggaggttgcagtgagctgagatcacgccactgcactctagcctgggcgacagagcgagactccatctca

SEQ ID NO: 319950 - DNA, 4666 bp, Homo sapiens
  misc_feature (915)..(915): n is a, c, g, or t
  misc_feature (991)..(991): n is a, c, g, or t
  misc_feature (1035)..(1035): n is a, c, g, or t
  misc_feature (1763)..(1763): n is a, c, g, or t
cgtgcctcggtttccgttagcaaccagaggcttctaaacaacctaccctccttccccattttctgtggtccaactaccctcggcgatcccaggcttggcggggcaccgcctggcctctcccgttcctttaggctgccgccgctgcctgccgccatggcagagttgggcctaaatgagcaccatcaaaatgaagttattaattatatgcgttttgctcgttcaaagagaggcttgagactcaaaactgtagattcctgcttccaagacctcaaggagagcaggctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccggtaataaaatttgaacttgcaactgtgacaataatggcccaagcataatcttaaaagttagtgaacatctttggctgcatattttcttggggctagtgtgtgaggaaatttgggtagggtaacagcaaagcattgagtcactgagtgatctcttgggtaccactaagcacccttttaaaagttctctgtttctactgttcctaggtattacaaaggccatcgagatttatgaaattgcttttcaggctatcattaattatttcttacagcatttttgttagcttggtcagtattaccatcagtctttatagattggtcaactaagaaatagagattatgagacagttgaaaagtcaattcaaatataataaataccatcaattcaatccagtagcattggaagttttctaaataatggaatttaaaagtatacatttantaactttgaaataggaaatatacaaaaaagcttataatatggacatctaagagctcaaattcaaaaaatatggtanaattggtgaagttgaaactcattttaagaaaaagcatgccaganatcaggaaggactgaccgccaagccccgtgaactactctaagcacagtcacagcacatcagttcacatgcagagtgttgaacaacgctgaggacaacctatgagctggggaggaaaatcattgaacttctgccactgtcagtagatgactggtgagaaaactctgagaaggtggtgctttaagaagcttagaagctgactgctgttaacactctaagcttgtgtgtagtcacttctcattggcctttgcaaatcttcagatggcacacccccactatctgtctttcctaggaatttgtggtactctttttcagtagatactatggactattttcatttttctgagactactttattaagaatcttttttgaacacctactagctaacaatacacattatgtaataaaacagtctcctcatagcacctcaagaatacaaagttgactataaattttcctcatatttgtattaacattatggtttatttctagcagtagatattgcatacctagtagatacaaaatgccaggtactgtggatgattacatttgagtccatgtggtttaggttctcaaccatttgcaactaacatttttgatatggtgaagtttggtccatcttgctctgttctctctggcatgtaatgggttggtaccagtgattttactcttcttgcgtgtgatataaatctattttaaatgaataatttttatctttgctttcttctncaagagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagaccattgaaatacaggctacaaatgcactggatgaaaagtcaaaactagaaaaagcactgcaagatttacagcttgatcaaggaaatcaaaaggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaaggaattagaaaagaaatttcagcaaacagcagcttatcgaaacatgaaagagattcttaccaagaagaatgaccaaatcaaagatctgaggaaaagactggcacaatatgaacctgaagattaaaactgaagatttcctctggaagctaccacatgcaaacatacaagcagtctcacctcaggcatgtattttgaaaagcattttgtcatatcccctctccttatttttctaatatttagactttgaatatttagaactagagttcctattttcagctagttgaaaacagagaaaacctagtgattctgtctggtcatcccacacacctctctactgagtgctccagagtcttagctcacatgcactgagaattctttacagcaaagaagagatttttagagtgggaagaagaggcttatccttctgcattagtataaagagtctgtatttttaataaatgttaaataagctaacaatgtttgtacttatgcattccccatgggtaaaaataaataatagcattgttaaagatagttattaccaaaaaaagagagttattacaaataaatatgtctctttatttttaaaaatgaaatcttaattcatttactctatttgatgataaactataaattcattgaaaatgtgaattctattatgggtagcctttttaccaattataaggaaaatttacagcagtgaacatgaacattcacttagcttcctcagtctctccatcttaaagatcatttatcagaggaggttcagcattttttgcagcataacttttcatgagtctgtattactaatggataagtcaaatccatcctgcacttctacagtttagaaagtatctggactcagaataaatgtaatatttatacttgtttccagaatgttattttacattttatgttcaataagaacactttttaaaagacgtatattcaacataaaatcagctatcagacttcagattagactttatttatgtgggtctataataattgtattttcaagaggttttcactatatttgtattggcctggttttctcagacgattttggacaaatcattagaaactgggcatcatatccacagttatgtaaggcagtgatatactataaggataaacaaagtcaagtccataaagcaataatccctcagaaggaaagtccttacttttcacatattaatatttagtaatttttcctgcttctaaaagtgagagtatcacaccctaaatgaacactgtctactaagagacatcattccatttccacaaatgaagattttattccaagaaacgagtttactgattggagcatagggcttgttgttatttttattcaagcttttagtaatagccttgaatttattatttttcttataggctttttgttaaaatagtgaaggaacaaatgttaaagggtaagataatttccctgcaaaaggacacagaaggcagtcttaagaagatgaatggatgagagaagggagagaataaaatgcaataacgagccagcatttactatgtattttctcctcacctgtctctccatatttaggtcacttaccagtttctgtgcccttttggagcttttgttgagggcttcattctcaccctgtatttctttagccctaaattgacactctctccaaaaatccattccattgtctgtggaccaagatgttctatgtaattcagaagcagaactcttggctaaagggctagtgtggccttcagaaaccattcaattattttctccctacacctttgtcagtttgaaaccagtgaggaaaaaaggtatgttgataagaaacctatattgctaggtagaatttgtacttgttttcttggtagcagttttgaaatattctgtacagtacgttcctattgtttaataataaattcaaaaatatttctaaaaccttaaaaccaactatgccaagcattaagataaacaaatatgatgttctttgacgtaaatcaacgtgatgattctttcacatgtaaacacattttagtgtttctggtttgtcatttttgttgttgttgttgttgttgttatttactctataccctttagcaaaatacagttttaaatttttattgtttttagtagtttcccaactttaagacttatctaatttaactgagaaagaaagcctttttcatatatatatatattggatttctaaggatggtggtttgagccttgattagacttttgatgtgctaagccagacaggcagtctgtacattgatggccatcacaatgcagctttggtttaatttaattcaggcctgctgctgagttatgcacagactttttgttgaccaaaataaaatataaagggttttcttctgtttgacatttgtgttcattttttctctttatgtattacattttaacctatattaaataaatgtttaaatgata

SEQ ID NO: 319951 - DNA, 353 bp, Homo sapiens
tcttggttcactgcaacctctgcctcccaggttcaagtaattctcctgcctcagcctccccagtaactgggattataggtgcctgccaacacgcctggctaatttttatatttttagtagagacgaggtttcaccatgttggccaggctggtctcgaacacctgaactcaggttatctgcctgcctcggcctcccagtgtgctgggattacaagtgtgagccactgcgcctggccaaggaacactctttgttctatgctacctactaggacagctagtctactcagttaccccaaaaccaaaaggatagtaactcaacaagctcagaatacaccattctgcttgcagccattg

SEQ ID NO: 319952 - DNA, 298 bp, Homo sapiens
tatccttcccgtactaattaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacacacgaatgttcaggtaccgagctgattgtatcag

SEQ ID NO: 319953 - DNA, 837 bp, Homo sapiens
  misc_feature (771)..(771): n is a, c, g, or t
  misc_feature (829)..(829): n is a, c, g, or t
tatccttcccgtactaattaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaatactaccaatcaatactcatcattaataatcataatggctatagcaataaaactaggaatagccccctttcacttctgagtcccagaggttacccaaggcacccctctgacatccggcctgcttcttctcacatgacaaaaactagcccccatctcaatcatataccaaatttctccctcattaaacgtaagccttctcctcactctttcaatcttatccatcatggcaggcagtttgaggtggattaaaccaaacccaactacgcaaaatcttagcatactcctcaattacccacataggatgaataatagcagttctaccgtacaaccctaacataaccattcttaatttaactatttatattatcctaactactaccgcattcctactactcaacttaaactccagcaccacaaccctactactatctaattctaccgtacaaccctaacataaccattcttaatttaactatttatattatcctaacnactaccgcattcctactactcaacttaaactccagcaccacaaccctactctgaaagngggtccga

SEQ ID NO: 319954 - DNA, 972 bp, Homo sapiens
  misc_feature (906)..(906): n is a, c, g, or t
  misc_feature (964)..(964): n is a, c, g, or t
tatccttcccgtactaattaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaatactaccaatcaatactcatcattaataatcataatggctatagcaataaaactaggaatagccccctttcacttctgagtcccagaggttacccaaggcacccctctgacatccggcctgcttcttctcacatgacaaaaactagcccccatctcaatcatataccaaatttctccctcattaaacgtaagccttctcctcactctttcaatcttatccatcatggcaggcagtttgaggtggattaaaccaaacccaactacgcaaaatcttagcatactcctcaattacccacataggatgaataatagcagttctaccgtacaaccctaacataaccattcttaatttaactatttatattatcctaactactaccgcattcctactactcaacttaaactccagcaccacaaccctactactatctatctcgcacctgaaacaagctaacatgactaacacccttaattccatccaccctcctctccctaggaggcctgcccccgctaaccggctttttgcccaaatgggccattatcgaagaattcacaaaaaacaatagcattctaccgtacaaccctaacataaccattcttaatttaactatttatattatcctaacnactaccgcattcctactactcaacttaaactccagcaccacaaccctactctgaaagngggtccga

SEQ ID NO: 319955 - DNA, 706 bp, Homo sapiens
tatccttcccgtactaattaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaatactaccaatcaatactcatcattaataatcataatggctatagcaataaaactaggaatagccccctttcacttctgagtcccagaggttacccaaggcacccctctgacatccggcctgcttcttctcacatgacaaaaactagcccccatctcaatcatataccaaatttctccctcattaaacgtaagccttctcctcactctttcaatcttatccatcatggcaggcagtttgaggtggattaaaccaaacccaactacgcaaaatcttagcatactcctcaattacccacataggatgaataatagcagttctaccgtacaaccctaacataaccattcttaatttaactatttatattatcctaactactaccgcattcctactactcacacacagtcattcagagcggggaatccatct

SEQ ID NO: 319956 - DNA, 645 bp, Homo sapiens
  misc_feature (579)..(579): n is a, c, g, or t
  misc_feature (637)..(637): n is a, c, g, or t
acgatggcaaggcacttcctgcaacaacgcatctcatattcgcaatgactattacaacaacaaccatgtgcaatgaaccataaccaatactaccaatcaatactcatcattaataatcataatggctatagcaataaaactaggaatagccccctttcacttctgagtcccagaggttacccaaggcacccctctgacatccggcctgcttcttctcacatgacaaaaactagcccccatctcaatcatataccaaatttctccctcattaaacgtaagccttctcctcactctttcaatcttatccatcatggcaggcagtttgaggtggattaaaccaaacccaactacgcaaaatcttagcatactcctcaattacccacataggatgaataatagcagttctaccgtacaaccctaacataaccattcttaatttaactatttatattatcctaactactaccgcattcctactactcaacttaaactccagcaccacaaccctactactatctaattctaccgtacaaccctaacataaccattcttaatttaactatttatattatcctaacnactaccgcattcctactactcaacttaaactccagcaccacaaccctactctgaaagngggtccga

SEQ ID NO: 319957 - DNA, 482 bp, Homo sapiens
tatccttcccgtactaattaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaatactaccaatcaatactcatcattaataatcataatggctatagcaataaaactaggaatagccccctttcacttctgagtcccagaggttacccaaggcacccctctgacatccggccatgatgataagattgagagagtgaggagaaggcttacgtctagtgagggagagatttggtatatgattgtgctgcgctgctacg

SEQ ID NO: 319958 - DNA, 428 bp, Homo sapiens
tatccttcccgtactaattaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaatactaccaatcaatactcatcattaataatcataatggctatagcaataaaactaggaatagccccctttcacttctgagtcccagaggttacccaaggcacccctctgacatccggcctctgccaataggggggtcctctagagcagc

SEQ ID NO: 319959 - DNA, 445 bp, Homo sapiens
tatccttcccgtactaattaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaatactaccaatcaatactcatcattaataatcataatggctatagcaataaaactaggaatagccccctttcacttctgagtcccagtgtacaaaaaggaacacgctataaataccggctgcttcttgtgaccatgacaacagactagcacatgtcatccgtagtgg

SEQ ID NO: 319960 - DNA, 545 bp, Homo sapiens
tatccttcccgtactaattaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaatactaccaatcaatactcatcattaataatcataatggctatagcaataaaactaggaatagccccctttcacttctgagtcccagctggactgatctcggaaattaattagccactcattcatcgacctccccaccccatccaacatctccgcatgatgaagctacggctcactccttggcgcctgcctgatcctcgaggggtaaccgtcacggggcctgagctggacccagtctgcgaggtgagggccgccgtcgaccggatgc

SEQ ID NO: 319961 - DNA, 374 bp, Homo sapiens
  misc_feature (308)..(308): n is a, c, g, or t
  misc_feature (366)..(366): n is a, c, g, or t
aaaaatgttgagcatgagggtggatcacgaggtcaggagttcagaccagctggccaagatggtgaaatcctcagtcaacttaaactccagcaccacaaccctactactatctatctcgcacctgaaacaagctaacatgactaacacccttaattccatccaccctcctctccctaggaggcctgcccccgctaaccggctttttgcccaaatgggccattatcgaagaattcacaaaaaacaatagcattctaccgtacaaccctaacataaccattcttaatttaactatttatattatcctaacnactaccgcattcctactactcaacttaaactccagcaccacaaccctactctgaaagngggtccga

SEQ ID NO: 319962 - DNA, 836 bp, Homo sapiens
tatccttcccgtactaattaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatcccccttccaaacaacaatccccctctacctaaaactcacagccctcgctgtcactttcctaggacttctaacaccctgacctcaactaaaaaaaaaaaaaaaaaaaaaaaaaaaaaaaaaaaaaaaaaaaaaaaaaaagaggggggcgcgcgcgcacagaaaaatacccccgccggggggccccacatagagccgcggccccccagttttggtggacaaacgagggggcgccccaaggagggggccgctaatataaaaagacgaggcagaacggggcgcgggttaaaaaaaaccgcgggagcgagggggaaaacctacgacaaaccagggggcacctcctggggggaagacggcgacccccctaaccacgcccgggggggcggcgaaccatacaagggggcaaaaacaaccctatcacctcaacacagagcaataacaaagccccgcatcaggggtaaaacactacacaaccttacacagggcgggtaatcaacggcgggcgacaagcaacaaggcccgaatgatcgcctgcgccacgcaaaaactatcgccacaccgcggcggacatgagcactcgcaaacacctatttacccaccgaggacaggtcaaaaaagagaat

SEQ ID NO: 319963 - DNA, 14083 bp, Homo sapiens
cgttaaatgcaaacgctgctctggctcatgtgtttgctccgaggtataggttttgttcgactgacgtatcagatagtcagagtggttaccacaccgacgttgtagcagctgcataataaatgactgaaagaatcatgttaggcatgcccacctaacctaacttgaatcatgcgaaaggggagctgttggaattcaaatagactttctggttcccagcagtcggcagtaatagaatgctttcaggaagatgacagaatcaggagaaagatgctgttttgcactatcttgatttgttacagcagccaacttattggcatgatggagtgacaggaaaaacagctggcatggaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319964 - DNA, 14014 bp, Homo sapiens
atgctgtctgtgaagctgaatctgtgagaacacctcactattcacggcaaccggagtggaagaaacaggtgcaaaaagattgtgtgtttgtctgcttttgtgaggctggtcagagattctgtgcctgctttatctgtgcttggctatgactctacctccaggtttaccataccccatagaatgtgtaagagaaaagtaccaacagggaaatcagcaaaaagctttcctatgaaggtgtgtagccagcctccgcagaatttgaaatgtctgaggtttcttctgatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319965 - DNA, 13778 bp, Homo sapiens
tcactgacacatagagtaacttctagttctccaagctctactcatgatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319966 - DNA, 9787 bp, Homo sapiens
gttcaagagatcaggaggaacattcgacctgagaaagacagattgcaatgactgagattattttgctaattttttttccagcctatttccttaatgctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319967 - DNA, 7353 bp, Homo sapiens
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319968 - DNA, 7424 bp, Homo sapiens
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319969 - DNA, 7062 bp, Homo sapiens
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319970 - DNA, 4656 bp, Homo sapiens
ctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319971 - DNA, 4649 bp, Homo sapiens
ctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319972 - DNA, 1678 bp, Homo sapiens
ctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctcacaatcagtaatgtgtgtctttgtatctcatgtgtggtcatatctagtcactgtctactcacaaatcagtaaatgtgtgtctttttgtatctcattgtgtggtcatatctagtcacttgtttctaccaaaagaaaatatagtcacaggaaactactcacgtaagtagtaatgattctcaagatcaaaggggag

SEQ ID NO: 319973 - DNA, 13955 bp, Homo sapiens
  misc_feature (2)..(3): n is a, c, g, or t
gnntcctggcatcagttactgtgttgactcactcagtgttgggatcactcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319974 - DNA, 13903 bp, Homo sapiens
cgttaaatgcaaacgctgctctggctcatgtgtttgctccgaggtataggttttgttcgactgacgtatcagatagtcagagtggttaccacaccgacgttgtagcagctgcataataaatgactgaaagaatcatgttaggcatgcccacctaacctaacttgaatcatgcgaaaggggagctgttggaattcaaatagactttctggttcccagcagtcggcagtaatagaatgctttcaggaagatgacagaatcaggagaaagatgctgttttgcactatcttgatttgttacagcagccaacttattggcatgatggagtgacaggaaaaacagctggcatggaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319975 - DNA, 13281 bp, Homo sapiens
cgttaaatgcaaacgctgctctggctcatgtgtttgctccgaggtataggttttgttcgactgacgtatcagatagtcagagtggttaccacaccgacgttgtagcagctgcataataaatgactgaaagaatcatgttaggcatgcccacctaacctaacttgaatcatgcgaaaggggagctgttggaattcaaatagactttctggttcccagcagtcggcagtaatagaatgctttcaggaagatgacagaatcaggagaaagatgctgttttgcactatcttgatttgttacagcagccaacttattggcatgatggagtgacaggaaaaacagctggcatggaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319976 - DNA, 12963 bp, Homo sapiens
  misc_feature (2)..(3): n is a, c, g, or t
gnntcctggcatcagttactgtgttgactcactcagtgttgggatcactcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttatgaaagagaagatgttcaaaagaaaacattcacaaaatgggtaaatgcacaattttctaagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319977 - DNA, 7633 bp, Homo sapiens
  misc_feature (2)..(3): n is a, c, g, or t
gnntcctggcatcagttactgtgttgactcactcagtgttgggatcactcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttatgaaagagaagatgttcaaaagaaaacattcacaaaatgggtaaatgcacaattttctaaggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319978 - DNA, 12671 bp, Homo sapiens
atgctgtctgtgaagctgaatctgtgagaacacctcactattcacggcaaccggagtggaagaaacaggtgcaaaaagattgtgtgtttgtctgcttttgtgaggctggtcagagattctgtgcctgctttatctgtgcttggctatgactctacctccaggtttaccataccccatagaatgtgtaagagaaaagtaccaacagggaaatcagcaaaaagctttcctatgaaggtgtgtagccagcctccgcagaatttgaaatgtctgaggtttcttctggtgagtaaaagctgcagataatcaacagccattcagaagaatgataaatgccacaagcatttggaaacaggcttccctaaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319979 - DNA, 12844 bp, Homo sapiens
atgctgtctgtgaagctgaatctgtgagaacacctcactattcacggcaaccggagtggaagaaacaggtgcaaaaagattgtgtgtttgtctgcttttgtgaggctggtcagagattctgtgcctgctttatctgtgcttggctatgactctacctccaggtttaccataccccatagaatgtgtaagagaaaagtaccaacagggaaatcagcaaaaagctttcctatgaaggtgtgtagccagcctccgcagaatttgaaatgtctgaggtttcttctggtgagtaaaagctgcagataatcaacagccattcagaagaatgataaatgccacaagcatttggaaacaggcttccctaaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319980 - DNA, 11741 bp, Homo sapiens
gggcgtgagggtactgtaaagagaatgttgcaaagaggagacaacttacaacaaagaatcacagatgagagaaagcgagaggaaataaagataaaacagcggctgttagagacaaaacataatgctctcaaggatttgaggtctcaaagaagaaaaaaggctctagaaatttctcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319981 - DNA, 8898 bp, Homo sapiens
  misc_feature (2)..(3): n is a, c, g, or t
gnntcctggcatcagttactgtgttgactcactcagtgttgggatcactcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttatgaaagagaagatgttcaaaagaaaacattcacaaaatgggtaaatgcacaattttctaaggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319982 - DNA, 12569 bp, Homo sapiens
cgttaaatgcaaacgctgctctggctcatgtgtttgctccgaggtataggttttgttcgactgacgtatcagatagtcagagtggttaccacaccgacgttgtagcagctgcataataaatgactgaaagaatcatgttaggcatgcccacctaacctaacttgaatcatgcgaaaggggagctgttggaattcaaatagactttctggttcccagcagtcggcagtaatagaatgctttcaggaagatgacagaatcaggagaaagatgctgttttgcactatcttgatttgttacagcagccaacttattggcatgatggagtgacaggaaaaacagctggcatggaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagctcactcctccactcgtacccacactcgaccgcggagcccttgcagccatgagggaacagctcaaaggccacgagactcaggtggtgtg

SEQ ID NO: 319983 - DNA, 10906 bp, Homo sapiens
cgttaaatgcaaacgctgctctggctcatgtgtttgctccgaggtataggttttgttcgactgacgtatcagatagtcagagtggttaccacaccgacgttgtagcagctgcataataaatgactgaaagaatcatgttaggcatgcccacctaacctaacttgaatcatgcgaaaggggagctgttggaattcaaatagactttctggttcccagcagtcggcagtaatagaatgctttcaggaagatgacagaatcaggagaaagatgctgttttgcactatcttgatttgttacagcagccaacttattggcatgatggagtgacaggaaaaacagctggcatggaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcacttgtttctaccaaaagaaaatatagtcacaggaaactactcacgtaagtagtaatgattctcaagatcaaaggggag

SEQ ID NO: 319984 - DNA, 8764 bp, Homo sapiens
cgttaaatgcaaacgctgctctggctcatgtgtttgctccgaggtataggttttgttcgactgacgtatcagatagtcagagtggttaccacaccgacgttgtagcagctgcataataaatgactgaaagaatcatgttaggcatgcccacctaacctaacttgaatcatgcgaaaggggagctgttggaattcaaatagactttctggttcccagcagtcggcagtaatagaatgctttcaggaagatgacagaatcaggagaaagatgctgttttgcactatcttgatttgttacagcagccaacttattggcatgatggagtgacaggaaaaacagctggcatggaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaaggtatgaattacattatttctaaaactactgttggctgtaataatggggtggtgaaactggatggaccatgaggatttgtttttccaatccagctaaactggagcttgggagggttcaagacgataaataccaactaaactcacggacttggctcagacttctattttaaaaacgaggaacataagatctcatttgcccgctgtcacaaaagtagtgacataaccaagagattaaacaaaaacttgctcatggtatgaaactagagcttgaggacactgatctagtctatctatactactctttctgacagacccctctcttcattctcatgctccttgatggcccaagccactctctcagttttttaaaaaattgttttatcaaggtctctggattcttcatgggaatgacttccagtttatattttttggcttggttccaaaaagctatcagctaaggaatgcatatacttacttcccctatgggtaaagtaaatgagaattttagaagccaactcacattttta

SEQ ID NO: 319985 - DNA, 408 bp, Homo sapiens
gtgaaatatcccaaattaaacaatctttgggagggcttctaaagtaggaagggtcaaaatttatgagtcctgagtgtgtatcatattttgaaatttatacatttgtatgtttattatgaaaagtaattctgttttcttttggatgacttagccccaggcagaggccaaagtgaatggcacaacggtgtcctctccttctacctctctacagaggtccgacagcagtcagcctatgctgctccgagtggttggcagtcaaacttcggactccatgggtaagtgtcctagctactctcagattttgttgtctgaagaaaggtagagtcgtattacagggacatgaatatttggccgtaagtgtttgactcatcttggtatcagggagccactgaaaatcatataccaggc

SEQ ID NO: 319986 - DNA, 739 bp, Homo sapiens
gattctaagacgtcacataagttttaatgagcttttacgttttttatcaggctagcagaaatggaaaacagcaatggatcttatctaaatgatagcatctctcctaatgagagcatgtaagtatcccatctctttttacaaaatgttcctgacaatgaaattgctttgagggatttagaggtaggatagcacaggatataggaattagcatcatattcatttgatcttttaaggagccattcatttacttttttcctttaattcttaatgccctggcatggaatgagctcatccaaattctggcattattagtattcagagtagcaaaaatagtttgccttactcttatttgaacttatttcataccatatgattacaaattgcagagtcccaagtatttatagtaatgcttaatctttgaccaaacctgccagatatttaaagggataggatattaattttaaagtcatggctaagtactattttctccactcatggggagtggaaacgtgatcttggtatagcatggctattcacatatggtaggttagttgggcattttccttcagaaatccaaagaagtagatttttgtgatttagcatcttcacaagataaataaagtgaggcaatcttatgaagagtttccagaggagaagtaccaattcaggttgcaggttgttagcaggatgataagccaaccctgttaaactttaaggacggagatagagcggtgctaag

SEQ ID NO: 319987 - DNA, 134 bp, Homo sapiens
gaacagatcctggtaaagcatgctcaagaggaacttccaccaccacctccccaaaagaagaggcagattactgtggattctgaaattaggaaaaggtgagagcatcttaagcttttatctgcaaatgaagtgga

SEQ ID NO: 319988 - DNA, 661 bp, Homo sapiens
attggaacaggaaaattatcagaagatgaagaaactgaagtacaagagcagatgaatctcctaaattcaagatgggaatgcctcagggtagctagcatggaaaaacaaagcaagtaagtccttatttgtttttaattaagaagactaacaagttttggaagcttgtgattattttgatgtggtttgatggttaagttacgattctcagtttgttcccaaggcacacagctttctttcaagggagactggttggattttcatagaaataacattttggttttcacttttgtaactaaaagagcagatgttagatagatgcactgttatctacagaactatgttttaagatttgccaaaattctgtcatagttattattttctaggttttcctccaaacattaaaatgtcactataaaaggcacagaagcatgcacaggagattgtgtacataaaatcacctattagctatagttgacacgaaacttctcttctgaagaaaaagcccttgaaaatattaaagagttactcatctatatatggaaatcctcttgaaaaacattattcaaacgttttgggaaattcttattaaaatacagtatggctatgaattatcttaagaatatatattgacttaataaaaaagaggatttgagacatttct

SEQ ID NO: 319989 - DNA, 481 bp, Homo sapiens
agctaaataaagtctcgctcaggtgtgtagtttgcttacctttctcgtttgttggttttgttttcttttcttgtcatctagtagccaaaaagagtaatggcagtttaccaaagccttaggagtgggtagctctttggatatcagggagcatttgcagaaacaagctgtgaaaagccagcctagctttgcaaccattgttctttctatcttttctgtttaacttattaatcgaactgatatacacctcctttgccatcttgccttctttcctttcatccttttgccctccttctctctccctcctgtctttgcaggctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcag

SEQ ID NO: 319990 - DNA, 14010 bp, Homo sapiens
  misc_feature (2)..(3): n is a, c, g, or t
gnntcctggcatcagttactgtgttgactcactcagtgttgggatcactcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319991 - DNA, 14096 bp, Homo sapiens
atgctgtctgtgaagctgaatctgtgagaacacctcactattcacggcaaccggagtggaagaaacaggtgcaaaaagattgtgtgtttgtctgcttttgtgaggctggtcagagattctgtgcctgctttatctgtgcttggctatgactctacctccaggtttaccataccccatagaatgtgtaagagaaaagtaccaacagggaaatcagcaaaaagctttcctatgaaggtgtgtagccagcctccgcagaatttgaaatgtctgaggtttcttctggtgagtaaaagctgcagataatcaacagccattcagaagaatgataaatgccacaagcatttggaaacaggcttccctaaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319992 - DNA, 9930 bp, Homo sapiens
gttcaagagatcaggaggaacattcgacctgagaaagacagattgcaatgactgagattattttgctaattttttttccagcctatttccttaatgtacgtgatattgtgattgattttcatgcagagatccctgatcctatagttttgtttgctatttatttttctccttcacattttttttctatcaacagagctgaatgagtgccaggaagctgcgaaatctgtcttacaaaaaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319993 - DNA, 4617 bp, Homo sapiens
ctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319994 - DNA, 7392 bp, Homo sapiens
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319995 - DNA, 7064 bp, Homo sapiens
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319996 - DNA, 5637 bp, Homo sapiens
gggttttctcaggattgctatgcaacaggatcagtgctgtagtgcccggttcaagctgaaaatgttacacaggaagacataccatgtaaaggacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319997 - DNA, 4688 bp, Homo sapiens
ctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319998 - DNA, 13951 bp, Homo sapiens
  misc_feature (2)..(3): n is a, c, g, or t
gnntcctggcatcagttactgtgttgactcactcagtgttgggatcactcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagagcattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 319999 - DNA, 9078 bp, Homo sapiens
  misc_feature (2)..(3): n is a, c, g, or t
gnntcctggcatcagttactgtgttgactcactcagtgttgggatcactcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttatgaaagagaagatgttcaaaagaaaacattcacaaaatgggtaaatgcacaattttctaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 320000 - DNA, 6650 bp, Homo sapiens
tgagctcggtaccattcctaataggatataaccacagcaggaccattgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtaaaaac

SEQ ID NO: 320001 - DNA, 11226 bp, Homo sapiens
cgttaaatgcaaacgctgctctggctcatgtgtttgctccgaggtataggttttgttcgactgacgtatcagatagtcagagtggttaccacaccgacgttgtagcagctgcataataaatgactgaaagaatcatgttaggcatgcccacctaacctaacttgaatcatgcgaaaggggagctgttggaattcaaatagactttctggttcccagcagtcggcagtaatagaatgctttcaggaagatgacagaatcaggagaaagatgctgttttgcactatcttgatttgttacagcagccaacttattggcatgatggagtgacaggaaaaacagctggcatggaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtaagtgtcctagctactctcagattttgttgtctgaagaaaggtagagtcgtattacagggacatgaatatttggccgtaagtgtttgactcatcttggtatcagggagccactgaaaatcatataccaggc

SEQ ID NO: 320002 - DNA, 4039 bp, Homo sapiens
  misc_feature (3925)..(3925): n is a, c, g, or t
cgttaaatgcaaacgctgctctggctcatgtgtttgctccgaggtataggttttgttcgactgacgtatcagatagtcagagtggttaccacaccgacgttgtagcagctgcataataaatgactgaaagaatcatgttaggcatgcccacctaacctaacttgaatcatgcgaaaggggagctgttggaattcaaatagactttctggttcccagcagtcggcagtaatagaatgctttcaggaagatgacagaatcaggagaaagatgctgttttgcactatcttgatttgttacagcagccaacttattggcatgatggagtgacaggaaaaacagctggcatggaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaaggnaaaaaaaaaaaaagaaaaactaagtaaaacaaaggaaataaatggaaaaagaaagaaatgcaacaatgcttgaagttgtatacagtctgctctttcctggttctaagagaagag

SEQ ID NO: 320003 - DNA, 400 bp, Homo sapiens
gtcatgcctttcatatttgtaaacttcaaaggatgacaataaagggacaacagcctttgaaattttgagagaagtatttgctgcttgcaagtcggttgatgtggttagctaactgccctgggccctgtattggttttgctcaataggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattgtgagttgttactggcaaacccacgtatgtgtttgcaactactactctattaacagaggcctactaataaa

SEQ ID NO: 320004 - DNA, 743 bp, Homo sapiens
ttagaggaagaaatggaaagggcccatgtttcatcctaattgataaaaagtttgatatactttagtattactaacgatttaaattgctactttgtaaggttttaagacattaacatgtttaacatgttttaaaacattaacatcaagactgatgattgaaatgctaattctgcagaagtgtctggtctttggaatagaaatctttttttctttcaattcaacatttgtaagtacctgcagaatacctggcacagtgctaggagaaggattcagagacgaatgtgacacattttcttccttcaaggtgtgctcataagtaagccatttatcatttatgtattacactacgtgttgaaatactctgaaaaaatttttttttttttttttggctgatgtacttttcccctttcagccagtaaaaaagaagaaaattaagcgtgaaataaagattttggagaatttgagaggaggtcccaacatcatcacactggcagacattgtaaaagaccctgtggtgagtatagtaggtgttagcaaggcccgccagagctgagatggtgtttgacctggagcacaactggcctctttttgttcctcccccaaccctcatcattaagtcctgctttgaaagtgcttaatcagatataccatttaactagcttgggtctttctttcaaagagacctccacccacagactatttcttattcttctaggctaagagactgatagcactggaaactg

SEQ ID NO: 320005 - DNA, 756 bp, Homo sapiens
ccccggaataccttacccttccctgtaagacctgtgaaaacgtatgagaccgtattcatctatccagcaaatatttattcatttttctcctgtatacccgcgctttatgtgaatttggaaaataccaagggtgaataaaccgtccctacccctaaggagcttgtcgtccatattgaaaaagaaaggtagaaaacataaagagtttaggttctgttaaagaaatatatctaaaattcagggggctgaagccaatgatcagacttcattgagaagctgacttaaatattccaaaagttaaggaaatgcttaccaataggattataggctgggtagtagggacattttagtcattgagcagtttaagaaatttgtaaaagcacaggtgagattgtgtcttccaggaacaaaatcatggagaaagaggtttgtcaagctaagaagttttattttcattctaaaggctataagtagtcagtggaggggtttcagtaaagagtgacgtgtctggtatattttatcaagagtatgctaatggcacagtgtgggtagcttagagaaagataagattgctcatggtttattctttttcagcctacgactaatagactggggtttggctgagttttatcatcctggccaagaatataatgtccgagttgcttcccgatacttcaaaggtcctgagctacttgtagactatcaggtaagaacagaagggcaggcacagttttgatcctgtgtttatttcgcacataa

SEQ ID NO: 320006 - DNA, 2672 bp, Homo sapiens
agcctcgctctggtccctgcggctggcggccgagccgtgtgtctcctcctccatcgccgccatattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaag

SEQ ID NO: 320007 - DNA, 2675 bp, Homo sapiens
cggtttttctccactgacatacaccaccctgacccctatgagaaaagaaagatcgaattttggcatattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaag

SEQ ID NO: 320008 - DNA, 5058 bp, Homo sapiens
agcctcgctctggtccctgcggctggcggccgagccgtgtgtctcctcctccatcgccgccatattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaaggttagatttaagttccctgtgtaaaggtcttgctgggtgggtgtctcatgttcacatctgaggggcctgcagccctgtaccgtggaggcttcccaaggcccccattttatacacccctcgttcgacccatggtaccgggcagagcagagaggccttaaaaaaaaagcaccacaagccaaagcgtctctggggattaaggatcctttgccataaaactcattttgtgtctcagcagtgcagggattggggatggaaaaagtcgccagtttttgtgtgtttgtgtgtgtgtgtaaagtggactttccactgtaatccaaccacctaagtttatcaggtgcttcactgaggaagcctagttttttaagcacaatagcaaaaccatcagctctgtattttctcctgttatttcattacagtagctgcttgtgggaactaggaaaaattcttccaacatattttaaggcctaaaatcttagttccccattctcctaccttatagattcacaggcctttctcgcctaggcatcatagataaacgtaattgtttggggagttgaatttaatgaacttatctaactttgtaacccatcttggctttagtaactttatcaaggtggtggctttagtgaatataatggtaaactttagaggacgctaaagcctccttttatagcgcttctcaacggtagggagagctgaagggaaaacattctgactgtgtggcagggtgattttcttccttatgaccacttacagtggatatttattgtacttgacccttttatgccctagaatgctgtgagggttaccatgttgaatttgtgcagaagctaaaagcaccagatgtgccagagatgcaatttgtgattatgtttgcactggattgtgatttgaacaggacacttataactaatgagttctttcttttgaggtggggagagggttgtaaatcaagacttcataccctatccttgtagctcggaaattgaggtgtagcttaggctgatgcggagagctgcagacagctggacctccttacacccatcagaccttggaataaaccgaaggtgaatgcagaggactctgaggtgccacccaagagccttttaaaataaatagaagtttttaaaaatgctacttaagagtcactgcagaagcatggagagagagaaaaaaaaaaaagacccaattgggtggggggtgggggggaggcaagggtttacagagtaacaacttacgtgttgttgtaaattacctcatctgtataccttgtattgggacactatttctcagcactacctgtgtctgcattgcttagatggcaggaaatggaatggccaacatgaaaggttatgttggcaattactctgaaagattttttaaagtatttttaaactttgtttgaagtggtccctcccctcttcctctgcttttttttaagtttgaagccagaaggccctccccaccttgctttattggttgtaattgtattgtaattggtatgactaaaccataactgtgctgggaagaagttgtgccatgaaggtctttaattttttttaataaaaacatttaaataaatgaaaaaaatgtccctgcagcctgagcaatatgcttctccaaccgacaccgtgtgtgatagatggctccgttttcacgttttgaattctgtttcttgtacttgaaatgcctgtccagcttacataagatagattaaattgttagagtgggactgtcagaggaatatatcttgtaaagtagatcctcagggtatggctaattactatagtcctaaagtagcagagaaaattagagattggttgacagatttgggaattttaatttcttcttagtttttaactttcatctttgcttcaccttttgacaagtatggttataattagaattgaccatttaagcatctcttgaaaaacctgattttgtcccaccagcaaattctctcccaagactggaattgggtttgcatagtagagagcctgtcttcccagggccttttcctagttaaagaaacacttaactaaaaaggctgtgtggtaaggtcatgctcagttccttcctcaaaaaatgagtctaaaattggtttatcctgaatccgacttcccccactgtcatcacttacccttgcccttctttttcctcagaacacctgaacttttgttgtattattttgtatctccccacttgcatgtaaactccctggtgaccttgcatgtcttatgcaatcctcattaaaaccttttgtttttttttaagtgggttcgttttccctcaggatcgaagagtattgaatggaatggcacgaggaaaatatttaacaccctacttggcttgtaataataggtgcttaataaattgtagttccact

SEQ ID NO: 320009 - DNA, 2741 bp, Homo sapiens
agcctcgctctggtccctgcggctggcggccgagccgtgtgtctcctcctccatcgccgccatattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctggtcgcttacatcactttactccataagcgcttcagtggggttatcctagtggctcttgtggaagtgtgcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaag

SEQ ID NO: 320010 - DNA, 2730 bp, Homo sapiens
agcctcgctctggtccctgcggctggcggccgagccgtgtgtctcctcctccatcgccgcctctatcaaggcttgtcaagcagtgtgctcatcacatggtaaatcatgcagcgtggaacctcataaaatctccaagaaacatcattcacccatactgactagtttcacatctctttgtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaag

SEQ ID NO: 320011 - DNA, 2894 bp, Homo sapiens
tgggcagctggagtaggggccttcttagggtccctctgggcggggctgagcttcccacctgcagagtgggtgcgaggtggagagaaccccaggcggggttgctggggcgaaagggggaagggaccaagacgtggggcagaacgtctggagttggagttaaggactagttaggagcctggatagaaaaagagaacctcatccacacctgaatagatgaatgagatttgggacttctgaaatgataagctttagatgggaaacctttgggaccttgggatgggatggatgtattttgcatttgagagagagatgaatccttggaaaccagaaggcagactgcgtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaag

SEQ ID NO: 320012 - DNA, 2462 bp, Homo sapiens
agcctcgctctggtccctgcggctggcggccgagccgtgtgtctcctcctccatcgccgccatattgtctgtgtgagcagaggggagagcggccgccgccgctgccgcttccaccacagaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaag

SEQ ID NO: 320013 - DNA, 2582 bp, Homo sapiens
cggtttttctccactgacatacaccaccctgacccctatgagaaaagaaagatcgaattttggcatattgtctgtgtgagcagaggggagagcggccgccgccgctgccgcttccaccacagctctatcaaggcttgtcaagcagtgtgctcatcacatggtaaatcatgcagcgtggaacctcataaaatctccaagaaacatcattcacccatactgactagtttcacatctctttgaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaag

SEQ ID NO: 320014 - DNA, 2387 bp, Homo sapiens
cggtttttctccactgacatacaccaccctgacccctatgagaaaagaaagatcgaattttggcatattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaag

SEQ ID NO: 320015 - DNA, 2643 bp, Homo sapiens
ttagaggaagaaatggaaagggcccatgtttcatcctaattgataaaaagtttgatatactttagtattactaacgatttaaattgctactttgtaaggttttaagacattaacatgtttaacatgttttaaaacattaacatcaagactgatgattgaaatgctaattctgcagaagtgtctggtctttggaatagaaatctttttttctttcaattcaacatttgtaagtacctgcagaatacctggcacagtgctaggagaaggattcagagacgaatgtgacacattttcttccttcaaggtgtgctcataagtaagccatttatcatttatgtattacactacgtgttgaaatactctgaaaaaatttttttttttttttttggctgatgtacttttcccctttcagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaag

SEQ ID NO: 320016 - DNA, 2066 bp, Homo sapiens
ttgggatagtttgaaagggacattcatgtccattaactccaagggtcctcacaactgccctgtgatacaagttacagtgacctcatggtccaataaaaaatgactttgccaagccccagctgcggccgcagcctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaag

SEQ ID NO: 320017 - DNA, 2005 bp, Homo sapiens
ggactttcctgatgcaaaggcttttgctggccaattggcagagatgccaggaatatgtgtggggatgggaaataggcctggtgagctcagccacctgaccctccttgctacacagaagcggtcacgtcctgtcaagtaacctgaattatgtttcttaaaattgagaggactcagatgtcttttttcactctagctatgttgtttccagtctccagttagctttgttgtcccactcagtggcagagcggtgcaagactaccctcttgagtttggatccctctttgcttttgtctgggctgttagccactaagaaaaatgtaggaatgaaatgttgggcttctgtgcccacgtggcccatttctcatgccctcttttggtcctgcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaag

SEQ ID NO: 320018 - DNA, 2255 bp, Homo sapiens
agcctcgctctggtccctgcggctggcggccgagccgtgtgtctcctcctccatcgccgccatattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagagccccagtttgagggacagcgggatatccaccatgctgctgtgagactcgggcagttgtgactggtttagaagtggatacacagggagaggtcttctggaaaaggtcttctggagagctgagatcagaagacaatcaactggcttcaaatctaaggagagacaggcacaaaatggaagagatgacatgggcactggttacctggtaaacacaagtggacactggtgagggactgggtcatggagactgcagtagtctttacccttttcagcgtttttcaccatgaaccccactgggagcacacagaagattggagaaagttttaataaaatgtctcaagatctggaagaagacaatggcagctactgtgaaaggatcacagtgctccacccagacccttccctgtatcccctaccggacaaaagccttagtctgtggagggaaggacaccaaatcctgtcacccccttggatgaagctcccttgcatctgggggaatgaaacaggaacaaaacaaaactttccctgggcaggggcaggaatacacactgggcccagaactgggggaggaacaggagcactaaggaggacataaccccaaaatcagagacacaaagggcctgacagagactgagacttgatcagaacagagaattccctcctcccccacctgccaatggtaagctgacaagccttgagttagaagtaaaaatgttacaggagagagacaagagtatgggaagaagaccctttctgagggtcacaaagggaggacctaaagctgagcagggagcacacatggaaggagaaaatccctctggcaggccagcctgcaccctcagtccaaggtgtcattggaggaactggaagctgctgcattgggggtaaccatagcaacaataaacctcaaacctagcccaactcttttttttatttactttttagagacaaggtcttgctctattgcc

SEQ ID NO: 320019 - DNA, 1529 bp, Homo sapiens
agcctcgctctggtccctgcggctggcggccgagccgtgtgtctcctcctccatcgccgccatattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgccttcttttaccccatgccaccatagtggttcgctcccccaataaaatgctactaagctgagtggggaaacccagcaaggcctgtctgtctagattcttcttg

SEQ ID NO: 320020 - DNA, 4256 bp, Homo sapiens
agcctcgctctggtccctgcggctggcggccgagccgtgtgtctcctcctccatcgccgccatattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaaggttagatttaagttccctgtgtaaaggtcttgctgggtgggtgtctcatgttcacatctgaggggcctgcagccctgtaccgtggaggcttcccaaggcccccattttatacacccctcgttcgacccatggtaccgggcagagcagagaggccttaaaaaaaaagcaccacaagccaaagcgtctctggggattaaggatcctttgccataaaactcattttgtgtctcagcagtgcagggattggggatggaaaaagtcgccagtttttgtgtgtttgtgtgtgtgtgtaaagtggactttccactgtaatccaaccacctaagtttatcaggtgcttcactgaggaagcctagttttttaagcacaatagcaaaaccatcagctctgtattttctcctgttatttcattacagtagctgcttgtgggaactaggaaaaattcttccaacatattttaaggcctaaaatcttagttccccattctcctaccttatagattcacaggcctttctcgcctaggcatcatagataaacgtaattgtttggggagttgaatttaatgaacttatctaactttgtaacccatcttggctttagtaactttatcaaggtggtggctttagtgaatataatggtaaactttagaggacgctaaagcctccttttatagcgcttctcaacggtagggagagctgaagggaaaacattctgactgtgtggcagggtgattttcttccttatgaccacttacagtggatatttattgtacttgacccttttatgccctagaatgctgtgagggttaccatgttgaatttgtgcagaagctaaaagcaccagatgtgccagagatgcaatttgtgattatgtttgcactggattgtgatttgaacaggacacttataactaatgagttctttcttttgaggtggggagagggttgtaaatcaagacttcataccctatccttgtagctcggaaattgaggtgtagcttaggctgatgcggagagctgcagacagctggacctccttacacccatcagaccttggaataaaccgaaggtgaatgcagaggactctgaggtgccacccaagagccttttaaaataaatagaagtttttaaaaatgctacttaagagtcactgcagaagcatggagagagagaaaaaaaaaaaagacccaattgggtggggggtgggggggaggcaagggtttacagagtaacaacttacgtgttgttgtaaattacctcatctgtataccttgtattgggacactatttctcagcactacctgtgtctgcattgcttagatggcaggaaatggaatggccaacatgaaaggttatgttggcaattactctgaaagattttttaaagtatttttaaactttgtttgaagtggtccctcccctcttcctctgcttttttttaagtttgaagccagaaggccctccccaccttgctttattggttgtaattgtattgtaattggtatgactaaaccataactgtgctgggaagaagttgtgccatgaaggtctttaattttttttaataaaaacatttaaataaatga

SEQ ID NO: 320021 - DNA, 2784 bp, Homo sapiens
agcctcgctctggtccctgcggctggcggccgagccgtgtgtctcctcctccatcgccgccatattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaaggtggatcttgggtaataacgtggtttatcaaacacaacaaacaaaaaatttggggcgtgcccgaagttaaactcctgggggggcccaggaagacgggcaggtcggaacgggagggggtcccaaaaagcggggcaggttaaccgggtcgggggtctaaggcaggca

SEQ ID NO: 320022 - DNA, 2789 bp, Homo sapiens
agcctcgctctggtccctgcggctggcggccgagccgtgtgtctcctcctccatcgccgccatattgtctgtgtgagcagaggggagagcggccgccgccgctgccgcttccaccacagctctatcaaggcttgtcaagcagtgtgctcatcacatggtaaatcatgcagcgtggaacctcataaaatctccaagaaacatcattcacccatactgactagtttcacatctctttgtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaag

SEQ ID NO: 320023 - DNA, 2801 bp, Homo sapiens
agaaggaatgtgggcagcctctagtggcaaagaccagtccctggctgacaaccagaaagaaatggggacctcagttgtgcaaccagaaggaacctgaatttggtcaacaacctgattgagcttggaagtgaatttcccagtttccaccaaggaatgcaaccttgagacaccttgatttttggcctcgtgagaccctaagcaaaagacctagctagccaagcccacccaacttctgacctacaataacttttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaag

SEQ ID NO: 320024 - DNA, 1572 bp, Homo sapiens
agcctcgctctggtccctgcggctggcggccgagccgtgtgtctcctcctccatcgccgccatattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggct

SEQ ID NO: 320025 - DNA, 2121 bp, Homo sapiens
agcctcgctctggtccctgcggctggcggccgagccgtgtgtctcctcctccatcgccgccatattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcatatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaag

SEQ ID NO: 320026 - DNA, 2396 bp, Homo sapiens
agcctcgctctggtccctgcggctggcggccgagccgtgtgtctcctcctccatcgccgccatattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctagccccagtttgagggacagcgggatatccaccatgctgctgtgagactcgggcagttgtgactggtttagaagtggatacacagggagaggtcttctggaaaaggtcttctggagagctgagatcagaagacaatcaactggcttcaaatctaaggagagacaggcacaaaatggaagagatgacatgggcactggttacctggtaaacacaagtggacactggtgagggactgggtcatggagactgcagtagtctttacccttttcagcgtttttcaccatgaaccccactgggagcacacagaagattggagaaagttttaataaaatgtctcaagatctggaagaagacaatggcagctactgtgaaaggatcacagtgctccacccagacccttccctgtatcccctaccggacaaaagccttagtctgtggagggaaggacaccaaatcctgtcacccccttggatgaagctcccttgcatctgggggaatgaaacaggaacaaaacaaaactttccctgggcaggggcaggaatacacactgggcccagaactgggggaggaacaggagcactaaggaggacataaccccaaaatcagagacacaaagggcctgacagagactgagacttgatcagaacagagaattccctcctcccccacctgccaatggtaagctgacaagccttgagttagaagtaaaaatgttacaggagagagacaagagtatgggaagaagaccctttctgagggtcacaaagggaggacctaaagctgagcagggagcacacatggaaggagaaaatccctctggcaggccagcctgcaccctcagtccaaggtgtcattggaggaactggaagctgctgcattgggggtaaccatagcaacaataaacctcaaacctagcccaactcttttttttatttactttttagagacaaggtcttgctctattgcc

SEQ ID NO: 320027 - DNA, 822 bp, Homo sapiens
agcctcgctctggtccctgcggctggcggccgagccgtgtgtctcctcctccatcgccgccatattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaaggtgagtacaagagataatttcagaggtatttggaatatagatttttaaaagtagttttgaagacttttttaaaacagcatttaaaaggtttttggtgccaaagcaaataaataaaattttattgtatcctatgaactcaatagaacaagttctgcttatttgacagatcgggaaactgaagcaagagaagtgatttgagttgactcatatagctaggttgtggcagagtaagggagcaaaggtacagtctcttctctcccagttattgcctaatacttatttcctttacttttcattatataatgaggcttttgttttcaataaataaatcattgcctctactttgtaaagatgaggagtcacaggactcgagggggacag

SEQ ID NO: 320028 - DNA, 741 bp, Homo sapiens
ttaaggtcaggtacagctggcgcgagggtttaagtgcgtagattgactgagcctggtggttttacccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagaggtgcgcgttgtggggca

SEQ ID NO: 320029 - DNA, 2436 bp, Homo sapiens
  misc_feature (2104)..(2104): n is a, c, g, or t
  misc_feature (2226)..(2226): n is a, c, g, or t
cagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagctggggctgggggcacagcctgggcattctgtggggaggccgtcctcggggtggggtggggccgagtggctgccctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtcaaaaacaaaanaaaaaaaagatccgagggctgtcgtatgcgtcggcgtgtgcgcgggacaaagagcagtggtagttggagagttgggcccttatgggccaataaagcgtgtgttcccctgggacccaggcatntgccttgtgtcacccatcggtggggtaaagcatctgcgccgggtcgctcccttaattgagggtagaggtctcgcaaattgtacatttggcgaatataaggcccccggggtttaacccttggcctttaacgtgaaattccggggccaaaccttacaacataaccgaacgaccatgaaacatcatacacaggacacaggcatacaatcagga

SEQ ID NO: 320030 - DNA, 1944 bp, Homo sapiens
cagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagctggggctgggggcacagcctgcgcctcccctcctatagccccatggtggggctaggctggggctcacccccctccccagctattttatgtctgtaattaaatatgttaaaataaagtcattatcggaagtca

SEQ ID NO: 320031 - DNA, 1977 bp, Homo sapiens
cagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgggtaggcccagcagtggttcttgacatcacacgatgaggcgcgcatctcccgtcatccagggagaccagaggacccttgtctcactcccagttggctcttagtcacagccccgctttgtctttgacatggacgtttgtgatgatcacgttcctcccgctccccgtgtctgaagagtgctccctgactggctgccgtctcctccctgtcgggtctggctgggttctccagagggagtgctgcggaggggacacagcagaggccccatgctcgtgatgtatgttgcagatcattttcccccattctgtccttttttgttaaattgtggtaaaaagcacataacataaactgtaccaccttaaccatttgaaagtatatatcccagactgtcttttatctttagacttcacttgtggtttgttgccacagtacaagtttatttttatgaagccca

SEQ ID NO: 320032 - DNA, 1938 bp, Homo sapiens
cagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattccccttcctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtca

SEQ ID NO: 320033 - DNA, 1653 bp, Homo sapiens
cagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtca

SEQ ID NO: 320034 - DNA, 1288 bp, Homo sapiens
cagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagccccctccccagctattttatgtctgtaattaaatatgttaaaataaagtcattatcggaagtca

SEQ ID NO: 320035 - DNA, 1287 bp, Homo sapiens
cagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgagggtctgctccctggacagagaggaaggaggtggagcagctggggctgggggcacagcctgggcattctgtggggaggccgtcctcggggtggggtggggccgagtggctgccctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtca

SEQ ID NO: 320036 - DNA, 1029 bp, Homo sapiens
cagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgccccctccccagctattttatgtctgtaattaaatatgttaaaataaagtcattatcggaagtca

SEQ ID NO: 320037 - DNA, 1070 bp, Homo sapiens
cagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggacctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagctggggctgggggcacagcctgggcattctgtggggaggccgtcctcggggtggggtggggccgagtggctgccctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtca

SEQ ID NO: 320038 - DNA, 1045 bp, Homo sapiens
cagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgaccctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtca

SEQ ID NO: 320039 - DNA, 838 bp, Homo sapiens
cagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgatgccgagcgcgggcgcggggggcggagctcggcggagacggggaaggggtcgccgtggctgccggtcctcgagttgggggctgccgcggacactgctaggcagacggcgagtaccgagcgcgggtggcgcggtgtccgtgggccacgctcagctgcggtcagaggccgacatgagtgccgcggggctgctggcccgggcccgggccagctggagcgccgcggccccgagtactacccga

SEQ ID NO: 320040 - DNA, 2094 bp, Homo sapiens
cagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagctggggctgggggcacagcctgggcattctgtggggaggccgtcctcggggtggggtggggccgagtggctgccctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtca

SEQ ID NO: 320041 - DNA, 457 bp, Homo sapiens
  misc_feature (8)..(8): n is a, c, g, or t
  misc_feature (13)..(13): n is a, c, g, or t
  misc_feature (31)..(31): n is a, c, g, or t
  misc_feature (38)..(38): n is a, c, g, or t
gttccctntgaancactttgacgaagtcacngtcaggncccacctggcttaacgctgcctggcgtcaccaaggccttcttggaagagaacaacctggactatatcatccgcagccacgaagtcaaggccgagggctacgaggtggctcacggaggccgctgtgtcaccgtcttctctgcccccaactactgctggtatgtctttgcctttccagcccagggcctctaccaagccacgggtttttgtcttggtttttgttttgcctttttatgatggaacatttcaaagacaggcaagagcagataaaagaacatgacgaacacccccgtatgtgtcacccacccatgcagcaccagtggggccagcctgtgagtgctgaccagctgccctgtgttacagcaagcccctggcacttcacctttctcccactgattgcccagcacttttcagaaggaaa

SEQ ID NO: 320042 - DNA, 2085 bp, Homo sapiens
cagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagctggggctgggggcacagcctgggcattctgtggggaggccgtcctcggggtggggtggggccgagtggctgctggcgcccctcatgatggtctcccactcagcaaggccgcatagaaacccaaaaggacgggggcgctggctccctatgcaggggtggtggtaccctccgatttgtgtattgaagcttcgggcaaaaaaaaaaaggggaaccggccaaagccttgaagcaagaaagaggggaaggaaagggactgtgccacgaatggtggaga

SEQ ID NO: 320043 - DNA, 2021 bp, Homo sapiens
cagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagcctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtca

SEQ ID NO: 320044 - DNA, 1822 bp, Homo sapiens
cagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagattctggtacaggtcaaagaggtcctctccaagctgagcacgctcgtggaaaccacactcaaagagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattccccttccccatggtggggctaggctggggctcacccccctccccagctattttatgtctgtaattaaatatgttaaaataaagtcattatcggaagtca

SEQ ID NO: 320045 - DNA, 2028 bp, Homo sapiens
cagcggcggcggccacccggcgctccttcgcgacggttcggccgggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcaagttccgggccgcgctgcgagactacgagacggtggtcaaggtgaagccccatgacaaggatgccaaaatgaaataccaggagtgcaacaagatcgtgaagcagaaggcctttgagcgggccatcgcgggcgacgagcacaagcgctccgtggtggactcgctggacatcgagagcatgaccattgaggatgagtacagcggacccaagcttgaagacggcaaagtgacaatcagtttcatgaaggagctcatgcagtggtacaaggaccagaagaaactgcaccggaaatgtgcctaccagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagctggggctgggggcacagcctgggcattctgtggggaggccgtcctcggggtggggtggggccgagtggctgccctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtca

SEQ ID NO: 320046 - DNA, 1519 bp, Homo sapiens
ctccctctctccctcacaccccacccctgtgcctttcctcctgaatatcccatttctctcctggcctcttggtcttcgtttgtgttccctgcttgtgtctcttgcatgattcttcttggtctactgtgaactcttacccttcccctcacctctgccccctccccacgtctctctctcggcccgtccctctccggtggcctcttttctttcagacagagaagattacagtatgtggggacacccatggccagttctatgacctcctcaacatattcgagctcaacggtttaccctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagctggggctgggggcacagcctgggcattctgtggggaggccgtcctcggggtggggtggggccgagtggctgccctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtca

SEQ ID NO: 320047 - DNA, 1334 bp, Homo sapiens
ggggcagagtcagggctggccagagggtctgctccctggacagagaggaaggaggtggagcagctggggctgggggcacagcctgggcattctgtggggaggccgtcctcggagaccaacccctatatatttaatggtgactttgtggaccgaggctccttctctgtagaagtgatcctcacccttttcggcttcaagctcctgtacccagatcactttcacctccttcgaggcaaccacgagacagacaacatgaaccagatctacggtttcgagggtgaggtgaaggccaagtacacagcccagatgtacgagctctttagcgaggtgttcgagtggctcccgttggcccagtgcatcaacggcaaagtgctgatcatgcacggaggcctgttcagtgaagacggtgtcaccctggatgacatccggaaaattgagcggaatcgacaacccccagattcagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactgcgaccagatggggaacaaagcctcctacatccacctccagggctctgacctacggcctcagttccaccagttcacagcagtgcctcatcccaacgtcaagcccatggcctatgccaacacgctgctgcagctaggaatgatgtgaggtgacgggcggggcggcctgcatcccagggcccctccaatcccaccggacccaggccctgggctaggggcagagcaggccccgccccagggcaatgttggacccccttttactttgtaaagtttgtatttattcccctttaggtttgcagagggggtaggggcagagtcaggggctggccagagggtctgctccctggacagagaggaaggaggtggagcagctggggctgggggcacagcctgggcattctgtggggaggccgtcctcggggtggggtggggccgagtggctgccctgcccccctcatttgcatggctcctcccccactcaagcaatagggccccgccataggaagacccccagagagagggtcagcaggggggccccgcctgcgcctcccctcctatagccccatggtggggctaggctggggctcacccccctccccagctattttatgtctgtaattaaatatgttaaaataaagtcattatcggaagtca

SEQ ID NO: 320048 - DNA, 592 bp, Homo sapiens
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320049 - DNA, 555 bp, Homo sapiens
  misc_feature (17)..(17): n is a, c, g, or t
  misc_feature (19)..(19): n is a, c, g, or t
gtatcaacgcagagtgncnattacggccggggttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320050 - DNA, 615 bp, Homo sapiens
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaagtttcatatttattttcc

SEQ ID NO: 320051 - DNA, 750 bp, Homo sapiens
  misc_feature (17)..(17): n is a, c, g, or t
  misc_feature (19)..(19): n is a, c, g, or t
  misc_feature (580)..(580): n is a, c, g, or t
gtatcaacgcagagtgncnattacggccggggttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaaaaaagagacacaacgcacanagaacacaacaaccaacaacaaacttttgtgtggccgcccttggcccctgggaagagttttctaaaacccttcctgtgggggcccggggccccgtgtgggttttgtggaccccggggcccccacgttgtcccgggagaacccgggcccagcctggtgtggggtttcccca

SEQ ID NO: 320052 - DNA, 598 bp, Homo sapiens
aattcgcggccgcgtcgacgcgagaagacgacagaaggggttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaaaataacgagctctaacaacatgtcgtcccg

SEQ ID NO: 320053 - DNA, 467 bp, Homo sapiens
cggacgccgtgggtgaccacgcgtcgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320054 - DNA, 508 bp, Homo sapiens
gcggccgcctactactactaaattcgcggccgcgtcgacatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaactcatctacagcctctgcccagcccagtgcttccacagtgcag

SEQ ID NO: 320055 - DNA, 283 bp, Homo sapiens
tcgtgccgctgttcttaattaaatggtagaatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320056 - DNA, 366 bp, Homo sapiens
aggcgtagtcggatgatactatgacatgattgacattggatgtggcgcgcgtaccgtgtccgtgatccagtgtccccctattatgaagtgctcatggtcgtgattgccgacttatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320057 - DNA, 396 bp, Homo sapiens
  misc_feature (24)..(24): n is a, c, g, or t
  misc_feature (99)..(99): n is a, c, g, or t
tgacccgggaaaatctccagttgnggaattggacttttgcctaaagacctgaaggaattgaggccagcttgaccaatgaatttgggtattctgcgcaangagcattccaagccaaggaagcagtaagtgtgaaggctctgaggccctgaaggtagggaactgttttaggaacagccaggaagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320058 - DNA, 444 bp, Homo sapiens
gcggccgcctactactactactactactactgctcgaattcaagcttctaacgatgtacggggacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaatcaataataaatgaaaacatgcggccgaatttcgagctaattggccc

SEQ ID NO: 320059 - DNA, 237 bp, Homo sapiens
gcggccgcctactactactactactactattcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320060 - DNA, 848 bp, Homo sapiens
agtgtgtaaagtattgttgaatatgaaataccagttgccaattcaggtggtgttctggattgcattttcaagtttcgcttcagctgccaaaccggggccagggactgcttcagtttctctgccttgctctttgtcagtgatgaccagggtgtaaaggtatctgctgcatcgaactgttaaacttcacgttgtccttatttttcttgatcttgacagatttggcatcctttcgtcgggctgtgagcaggaagtccttgatttcctcaattttgccgaggcatggcgagcgaggcgcgctgggctctggcgcggaccaggacctttctcacccacgtatcaccctagagacactcacaggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggtaagctaataaataaaacctggtgctaagtaggactgcttgtactaaattttttcggtaaaatgtaatgcatctggtttgaattatccaaggcttagtacacaaaccagtgtagtgctgctttgaagttcaaattctatccaaagagattttcattatagaaagtgcatggtagctctacattctcttatta

SEQ ID NO: 320061 - DNA, 1055 bp, Homo sapiens
  misc_feature (24)..(24): n is a, c, g, or t
  misc_feature (99)..(99): n is a, c, g, or t
tgacccgggaaaatctccagttgnggaattggacttttgcctaaagacctgaaggaattgaggccagcttgaccaatgaatttgggtattctgcgcaangagcattccaagccaaggaagcagtaagtgtgaaggctctgaggccctgaaggtagggaactgttttaggaacagccaggaagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaggggggcgcgcgccggcaaaatactccccctgcagggggcgcccacaagagacgacaccaacgcgtgtctagagaagagagagggacccacaaaagaggggcatgttttattatatacaagcagagagcaggagggcgcggagtcgtatataaacaaaaacgggggagaggacggaaaaaaacataggcggggcgacgctcgactcttattgttataaaacaaaaccaccctactaaattctcgatgcgagggaaggaaataattatgtggaccaaaccaaccacaccacgagccaaggagagatacactacaccccaaccgaccaggagcggagcacacaaaaaccaacacaaagcaaagaggaaggaggggacgaacgagcgggagggagggagaaaacaacaaacagaaggcgcaagaagaggagctggacggggcggcggcgaagccaaaagagagacggaagccggaagaacagcgaggcacgaacacaagacgaacgaaggcacacaaatcttttccaccggggacgggcaaacaaacaagaacgacaacgggggggc

SEQ ID NO: 320062 - DNA, 314 bp, Homo sapiens
gcggccgcctactactactaaattcgcggccgcgtcgacatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcattttattgcttgagtacacagacaaatttatgcgaccagggcagaggctgtagatgattcgtcgacgcggccgcgaatttagtagtagtagta

SEQ ID NO: 320063 - DNA, 383 bp, Homo sapiens
aaaatatgtcatagattgtaagtagtcagagctcattagaggtttaaaagaaataacgtgtaaagtttttagaagaatatctgaccagagttctcagtaaatgttagctgtggaatctcattaatccctttggtcatctgtattccagcaagctcactgtgatgatggttttccaacattcgcagtttccaccagaaaggttttccttagtgttgggtaaaccttccttggatgtctgagtgagctttatgtgcattctcacgttggtttctgtgatgtataaaagtatacccccatcttacagataggaaactatgccctgatttctgagccttgacatcatcacattctccagtttgtgtttcgtgttgaaagttaaaacg

SEQ ID NO: 320064 - DNA, 1097 bp, Homo sapiens
  misc_feature (896)..(896): n is a, c, g, or t
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaggggggggggggcgccaaaaaaacccccgggggggccccttccccccccctttcttggaaaggggccccccggggcgaaaaaaaccgacagacgcggcagtcaaaaaccgggcgagagaggaaacaaagctgcgtggggctcgtggagaaaccccatcggtgcgcggggccaaacaggggaccacccacaagtcaacgggccagcaaacaaaantggcggtgcgtgccagaccgcgttctgcgcgcggcgaattctgggttcataataagcgggtgtatgaaatacaggtggctctgtctatacgcgatccgtcgcagcactacctgcttcgccatgccatctgcacctcggttcatatccgacgtagtcaccgtacgttgctatgtagtaaaagtacgctaagcactgcttccc

SEQ ID NO: 320065 - DNA, 696 bp, Homo sapiens
  misc_feature (17)..(17): n is a, c, g, or t
  misc_feature (19)..(19): n is a, c, g, or t
gtatcaacgcagagtgncnattacggccggggttcgttgcctgatcgccgccatcatgggtcgcatgcatgctcccgggtgagctcggggcatcaagccggattgctgggcggggggtgggaggaagacagggagtgtgggcagcgggccgaggggatgatgttctgggctgctctggcactagccgccacctcacctcgagactgcttctctccccaggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320066 - DNA, 539 bp, Homo sapiens
gcggccgcctactactactaaattcgcggccgcgtcgacatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320067 - DNA, 558 bp, Homo sapiens
  misc_feature (29)..(29): n is a, c, g, or t
  misc_feature (31)..(31): n is a, c, g, or t
ctctctctctctctctctctctctctctntntctctctctctctctctcctcgtgccgatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320068 - DNA, 770 bp, Homo sapiens
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaacaaaaaaacaaaacaaaaaaacaaaaaatccgggagaatatcatctcgcgggcatcccgaggggcacaaacacctgtgtggtgggacacagcgggtcttagggcgcaacaacagtcggggaacaaaggccgagaaaagagataccccccggagaacaaaccctcggaggggag

SEQ ID NO: 320069 - DNA, 904 bp, Homo sapiens
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaaaaagggaaaaaaaaaaaaattttttggggggcttgggccctggaaaaagtttttaaaaccatttggtttgggggcggggcgcccagttaggctacatggtgacccgtgcgcacataaggtgtgttccccaagggaaatccgcgggccatcgaccataggggtctggggattcttcccccatttataaaaagggcccggggggggaacacggagggttcttggaccaattcccagaagggagttctcggaggacacatacgggatccattcacaggggagtgtccaagagagctcgatatcatttacc

SEQ ID NO: 320070 - DNA, 627 bp, Homo sapiens
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaaaataacgagctctaacaacatgtcgtcccg

SEQ ID NO: 320071 - DNA, 787 bp, Homo sapiens
  misc_feature (617)..(617): n is a, c, g, or t
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaaaaaagagacacaacgcacanagaacacaacaaccaacaacaaacttttgtgtggccgcccttggcccctgggaagagttttctaaaacccttcctgtgggggcccggggccccgtgtgggttttgtggaccccggggcccccacgttgtcccgggagaacccgggcccagcctggtgtggggtttcccca

SEQ ID NO: 320072 - DNA, 771 bp, Homo sapiens
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaaaaacacaaccataccaaacactctcttggggccgcttggcccctgagagaaggttttctacacccatccggtggggggccgggcccccatgggtagggcaactggccaacggggcccacaggaaccctggcctcacacgggctggttttccacataaaaaagccgggggcacgg

SEQ ID NO: 320073 - DNA, 727 bp, Homo sapiens
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaaaaaaaaaactcgagagactagttctctctctctccagggcctccccggtctggtggctacctgggggcccgggtctcctccgggccccattcggcgctgcgatgaagcgccactgtccggggaacttttg

SEQ ID NO: 320074 - DNA, 739 bp, Homo sapiens
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtatggggtctcggcgtgtgcatgcacacgccgagggcccatacatctcaacaacaaaattgtataaaaatggacaaataatctgaacagacacttcttaaaaagaagacatccaaatgaccaacaaatatatgaaaaaatgctcaccatcatcaatcatcagggaaatgcaaatctgcaaatcaaa

SEQ ID NO: 320075 - DNA, 1222 bp, Homo sapiens
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatagtaagtatcaactcttttgtcgttgttatcaagaataggagtcagccagtagtaaaagtcctagtagtaaatatgttcagccttgggggctagtagtaaatatgttcagccttgggggctattttgttaactgctctttgagctctggcctggtagtgggaaagcagccacaggcaatacataatcgaatgggtgtggctgcttgtctttaataaagacaagcagagggccatagttgcagaccccagatttagaccatgaataagccctttgactctcttttagatagtaggtagattttcctttcatacctctactcccaggagtttgaattaattttcacatgaattgctcactatgatgattggttgccagacattcgcagtttccaccagaaatgtttttccttatgttggccagttcttccttggacgtctgagtgagcatcttcattcattgtgcttgaacacaatgagttggttcaggtattcagaagtttggtgcactttatatagtttggatttattaactgtttgagaatagcaccattagtggggagattctgttaatgaatgtggagggactagtattaatcctgattttctttctttccccttttttctttttcagtgaatcatctacagcctctgccctggtcgcataaatttgtctgtgtactcaagcaataaaatgattgtttaactaaaa

SEQ ID NO: 320076 - DNA, 561 bp, Homo sapiens
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaactcatctacagcctctgcccagcccagtgcttccacagtgcag

SEQ ID NO: 320077 - DNA, 558 bp, Homo sapiens
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320078 - DNA, 606 bp, Homo sapiens
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggtaagctaataaataaaacctggtgctaagtaggactgcttgtactaaattttttcggtaaaatgtaatgcatctggtttgaattatccaaggcttagtacacaaaccagtgtagtgctgctttgaagttcaaattctatccaaagagattttcattatagaaagtgcatggtagctctacattctcttatta

SEQ ID NO: 320079 - DNA, 697 bp, Homo sapiens
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcgtcttgctcttgtcgcccagtctggagtgcagtggcgcgatctcagctcactgcaacctccacctcctggattcaagcgattctcctgcctcagcctcccgaataggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320080 - DNA, 432 bp, Homo sapiens
  misc_feature (418)..(419): n is a, c, g, or t
  misc_feature (425)..(425): n is a, c, g, or t
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaaggctccaaggtgattggaggatcctcnngagtcntccaaag

SEQ ID NO: 320081 - DNA, 875 bp, Homo sapiens
  misc_feature (17)..(17): n is a, c, g, or t
  misc_feature (19)..(19): n is a, c, g, or t
gtatcaacgcagagtgncnattacggccggggttcgttgcctgatcgccgccatcatgggtcgcatgcatgctcccgggtgagctcggggcatcaagccggattgctgggcggggggtgggaggaagacagggagtgtgggcagcgggccgaggggatgatgttctgggctgctctggcactagccgccacctcacctcgagactgcttctctccccaggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaaaaacacaaccataccaaacactctcttggggccgcttggcccctgagagaaggttttctacacccatccggtggggggccgggcccccatgggtagggcaactggccaacggggcccacaggaaccctggcctcacacgggctggttttccacataaaaaagccgggggcacgg

SEQ ID NO: 320082 - DNA, 664 bp, Homo sapiens
  misc_feature (8)..(8): n is a, c, g, or t
  misc_feature (21)..(21): n is a, c, g, or t
  misc_feature (23)..(23): n is a, c, g, or t
ccccggangcagaattcgcanangccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaaaaaaaaaactcgagagactagttctctctctctccagggcctccccggtctggtggctacctgggggcccgggtctcctccgggccccattcggcgctgcgatgaagcgccactgtccggggaacttttg

SEQ ID NO: 320083 - DNA, 393 bp, Homo sapiens
gcggccgcctactactactactactactactgctcgaattcaagcttctaacgatgtacggggacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320084 - DNA, 336 bp, Homo sapiens
gcggccgcctactactactaaattcgcggccgcgtcgaccaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320085 - DNA, 440 bp, Homo sapiens
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgtgttgcccaggccaggctggagtgcagtggcatgagctcggcccactgcacccgtgacctcctgcgctcaagcgattctcccatctcagcccacttcaggc

SEQ ID NO: 320086 - DNA, 548 bp, Homo sapiens
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320087 - DNA, 352 bp, Homo sapiens
  misc_feature (114)..(114): n is a, c, g, or t
  misc_feature (140)..(140): n is a, c, g, or t
gttaatgtcatttaaaaagtaaagcaatggaaattattagcatgctttgatttatagataatggctaagattgatgcttggtaaaaccctaattttcctgttttaatgaaaaanaaaaaaaaaaaaaaaaaaaaactggngactttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320088 - DNA, 398 bp, Homo sapiens
  misc_feature (29)..(29): n is a, c, g, or t
  misc_feature (31)..(31): n is a, c, g, or t
  misc_feature (384)..(385): n is a, c, g, or t
  misc_feature (391)..(391): n is a, c, g, or t
ctctctctctctctctctctctctctctntntctctctctctctctctcctcgtgccgatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaaggctccaaggtgattggaggatcctcnngagtcntccaaag

SEQ ID NO: 320089 - DNA, 422 bp, Homo sapiens
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320090 - DNA, 562 bp, Homo sapiens
  misc_feature (10)..(10): n is a, c, g, or t
cgccctcgantaggtgcgagagacgacagaggggcccgcttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320091 - DNA, 540 bp, Homo sapiens
gacccacgcgtccggacccacgcgtcgcatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320092 - DNA, 529 bp, Homo sapiens
  misc_feature (8)..(8): n is a, c, g, or t
  misc_feature (21)..(21): n is a, c, g, or t
  misc_feature (23)..(23): n is a, c, g, or t
ccccggangcagaattcgcanangccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320093 - DNA, 740 bp, Homo sapiens
  misc_feature (10)..(10): n is a, c, g, or t
cgccctcgantaggtgcgagagacgacagaggggcccgcttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaacaaaaaaacaaaacaaaaaaacaaaaaatccgggagaatatcatctcgcgggcatcccgaggggcacaaacacctgtgtggtgggacacagcgggtcttagggcgcaacaacagtcggggaacaaaggccgagaaaagagataccccccggagaacaaaccctcggaggggag

SEQ ID NO: 320094 - DNA, 951 bp, Homo sapiens
  misc_feature (620)..(620): n is a, c, g, or t
  misc_feature (652)..(652): n is a, c, g, or t
cggctaggtagaggctggggtaaatcggcagagggggtcgcatgcgtgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaaaaaaaaaaaccgagactaattctctctctccttttcttcccatggtctcagagcctgttcgagccattcaggtaaatggtctncattattacctggtcacaccagattttccccnagattcagaccatccagtctgattccccgtttctgggctcaagtttgactctaaaatctgtttgctattttaaaaagtccaagctgggtccccaggaagaagttttgccaccccggaaactttcaggaagaccgtgcaggcttcgaaggagctcccaagtcacagaaagcgctattgagacagggaggtccccaaatggtcctctgaagccggggtcaccaagtcagtccagatcacagttctgtgagcagcctgaaccttaagaaggggatacggccgttatctggaacaggcccggt

SEQ ID NO: 320095 - DNA, 563 bp, Homo sapiens
aattcgcggccgcgtcgacgcgagaagacgacagaaggggttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320096 - DNA, 971 bp, Homo sapiens
gcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagacaaaagaaaaaaagaggaaacgaaaaagaggagagagaagaaaaacagaacaaagacagaaagatagagcagaataagaaaggagggggggacgcaggatggaggagagaacaagagcggaggaggggagaaggaacgagaatagtaggaaggagatgcgagcgagggagaggggtagagaggtggggagaccggaagaaggagaggagggagaggagggggagcaggagaaggaggaaggagggaggaggaggagcgagcagagtggggagg

SEQ ID NO: 320097 - DNA, 510 bp, Homo sapiens
  misc_feature (17)..(18): n is a, c, g, or t
  misc_feature (27)..(27): n is a, c, g, or t
  misc_feature (30)..(30): n is a, c, g, or t
  misc_feature (32)..(32): n is a, c, g, or t
aggaattcggcacgagnnccatcaggntcncnggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 320098 - DNA, 675 bp, Homo sapiens
gacccacgcgtccggacccacgcgtcgcatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaaaaaaaaaactcgagagactagttctctctctctccagggcctccccggtctggtggctacctgggggcccgggtctcctccgggccccattcggcgctgcgatgaagcgccactgtccggggaacttttg

SEQ ID NO: 320099 - DNA, 645 bp, Homo sapiens
  misc_feature (17)..(18): n is a, c, g, or t
  misc_feature (27)..(27): n is a, c, g, or t
  misc_feature (30)..(30): n is a, c, g, or t
  misc_feature (32)..(32): n is a, c, g, or t
aggaattcggcacgagnnccatcaggntcncnggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaaaaaaaaaaaaaaactcgagagactagttctctctctctccagggcctccccggtctggtggctacctgggggcccgggtctcctccgggccccattcggcgctgcgatgaagcgccactgtccggggaacttttg

SEQ ID NO: 320100 - DNA, 5685 bp, Homo sapiens
ggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaaataagaaaactctaagcgaccccaacagccacctgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagcaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctcccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccaccgacggggactgctgagcctcctgggacagcgggctggcagggactggcaggaggcaggtgcagggaggcctggggcagcctcctgatggggatgtttggcctctgcttcctcccagttcacagccagagttgcctctcctcctcctcttccccaacccccagaccatgaccagccttagaaaatccatgtactctgttgttagagggcccagagttccttctccacccccgctctctctctcttggcctgagatctctgtgcaggaaccaagatggggctgaagcctctggaggcagttggttgggggcgggcaggcaggaggccctccctccacccccccaccctcagcccggcaacttctgggttccatgggttttagttccgttcttcgttttcttcctccgttattgatttctcctttctccctaagcccccttctgcttccacgcccttttcctctttgaagagtcaagtacaattcagacaaactgctttctcctgtccaaaagcaaaaaggcaaaggaaagaaagaaagcttcagaccgctagtaaggctcaaagaagaagaaaaacaccaaaaccacaagggaaaagaaaaacccagtttcttaggaaacgcaaacgatttattatccagattatttggataagtcctttttaagaaaaaaaaaagaaaatgaaaaacaacacaaaaaaaatagaaaactcttttcttgagtgtggatgagaatgggcacgctcacacttctggccagggtgaatgtgcctgtgtgtgtgtgtgtgtgtgtgtgtgtgtgtacatgtacgcgtgtgcattgaggagagagagactgaacagagagtacttgctgctaacgaatccatcttggactaaattctgacaaggcctcagtttccccagttgtgcagggagtaggtcagacagggttttcactgtctagatttagctggttagattttcctctaaaatcttaagcagatgctgaatccataaagccaaggagtgctgagggctggagtgggtgggccctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctctcttgatggccaggaatccagaatctgcccttccccaaccttggtttctccttctgtaaagcagagtgatggctgagaagtcctctctagctgcagaagcctgagcttcccggtgtcagtcagctctgcaacgtgggagccttggaggcgggtggcctggctgtgcttcatatgcccaggagtggagaaggaggctgagaagctggtttcccagctctgatctccacaggcacctcctataaccctcctctcacccaccccgctacggtctgagagatctgaaataacctttcccagtgggcagggttgccagggttgaggggacagcacataccacccccacccaacctgttcgaggggccctgcatggcacgggatgagtccctgccctgtgcagctgcctggcagtggctgggacaaggatcttgcagccagcacagaggcctcttcaaaggcctctccctcttggcactccaggcaaggcaggtgcccgcttccccaacacctccaggcagtgaccctagggcatgccccagcaggtctccgagcagccactgggacccgtctcagcacatcctggcctttgaaagtctgatatcctgagaggagggcaggttttagggccgcagttccagccagcgtccccagcctggcttccctgccatggactcagtagctcgtggggcttcttaccacccaccagccccgctggggtgcggcctggctgtgggcaaaggaggacttgcctggagatttgagagaagattccttctaccagggctgctgaggggccaggcctgcatcaggggctaggctctggctgggcccggaggctgagactaaggctttcgaccctggtgcctccatgtggatgctgcctcagacaaaggcagtgagccttccctgccaaagtgcccatcccatgggctcggcctcactggtcactgttagcccatgaacacgtgtgggcctcggtcacgtggctttgagggcagtctgaccaggctagaccacacgtgccgtgacagggggtgccattcccctcgcaggctctaatgtgcccacatgtagcctggcagtccaaagaccaagaatcaacttgcaaatctgccattaaactgctgtgcgacttcaggcatatcactgccttctctgggcttcagtgtccttttcatacctagaagtctgcggtctgaggctctttgggttcagacacactgttctaggcttctgtaggggaccttgtgatctgccgtgcccctcctccctgttcttttctgtcctccccaccccaccctcagaagctgcttgctctgcccccaggacaggagcttgacggatgaagtgcagccagccacccaggtgccatttccagtctgacttccagaaatgtgcaccatgtcctagagcacagacccattggctggagcctcctgggagggttcaaaccatcagctctatgagaaatgcccagaaaggctttgccgactccatccgtctgtggaggctgcctgcctccggggtgggatgggtggtttctcctccaattcagacccaagaggtagcccccgagggcatgtacctggtgggaagcagctcaggtacccttgggggttgcagggcccttacgcaggtatttctctctctctcctctctggggtgcgtgtgtgcgtgcgcgtgtgcgtgcctatgcttttctctgtgggcacatcaggatgcccctcggagagcatgtgcacgtgtccccacctgagcgagcgtgtgtgtgtgctcctctgcgtcccaggtttggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaa

SEQ ID NO: 320101 - DNA, 5321 bp, Homo sapiens
ggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaaataagaaaactctaagcgaccccaacagccacctgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagcaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctcccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccaccgacggggactgctgagcctcctgggacagcgggctggcagggactggcaggaggcaggtgcagggaggcctggggcagcctcctgatggggatgtttggcctctgcttcctcccagttcacagccagagttgcctctcctcctcctcttccccaacccccagaccatgaccagccttagaaaatccatgtactctgttgttagagggcccagagttccttctccacccccgctctctctctcttggcctgagatctctgtgcaggaaccaagatggggctgaagcctctggaggcagttggttgggggcgggcaggcaggaggccctccctccacccccccaccctcagcccggcaacttctgggttccatgggttttagttccgttcttcgttttcttcctccgttattgatttctcctttctccctaagcccccttctgcttccacgcccttttcctctttgaagagtcaagtacaattcagacaaactgctttctcctgtccaaaagcaaaaaggcaaaggaaagaaagaaagcttcagaccgctagtaaggctcaaagaagaagaaaaacaccaaaaccacaagggaaaagaaaaacccagtttcttaggaaacgcaaacgatttattatccagattatttggataagtcctttttaagaaaaaaaaaagaaaatgaaaaacaacacaaaaaaaatagaaaactcttttcttgagtgtggatgagaatgggcacgctcacacttctggccagggtgaatgtgcctgtgtgtgtgtgtgtgtgtgtgtgtgtgtgtacatgtacgcgtgtgcattgaggagagagagactgaacagagagtacttgctgctaacgaatccatcttggactaaattctgacaaggcctcagtttccccagttgtgcagggagtaggtcagacagggttttcactgtctagatttagctggttagattttcctctaaaatcttaagcagatgctgaatccataaagccaaggagtgctgagggctggagtgggtgggccctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctctcttgatggccaggaatccagaatctgcccttccccaaccttggtttctccttctgtaaagcagagtgatggctgagaagtcctctctagctgcagaagcctgagcttcccggtgtcagtcagctctgcaacgtgggagccttggaggcgggtggcctggctgtgcttcatatgcccaggagtggagaaggaggctgagaagctggtttcccagctctgatctccacaggcacctcctataaccctcctctcacccaccccgctacggtctgagagatctgaaataacgcttccctgccatggactcagtagctcgtggggcttcttaccacccaccagccccgctggggtgcggcctggctgtgggcaaaggaggacttgcctggagatttgagagaagattccttctaccagggctgctgaggggccaggcctgcatcaggggctaggctctggctgggcccggaggctgagactaaggctttcgaccctggtgcctccatgtggatgctgcctcagacaaaggcagtgagccttccctgccaaagtgcccatcccatgggctcggcctcactggtcactgttagcccatgaacacgtgtgggcctcggtcacgtggctttgagggcagtctgaccaggctagaccacacgtgccgtgacagggggtgccattcccctcgcaggctctaatgtgcccacatgtagcctggcagtccaaagaccaagaatcaacttgcaaatctgccattaaactgctgtgcgacttcaggcatatcactgccttctctgggcttcagtgtccttttcatacctagaagtctgcggtctgaggctctttgggttcagacacactgttctaggcttctgtaggggaccttgtgatctgccgtgcccctcctccctgttcttttctgtcctccccaccccaccctcagaagctgcttgctctgcccccaggacaggagcttgacggatgaagtgcagccagccacccaggtgccatttccagtctgacttccagaaatgtgcaccatgtcctagagcacagacccattggctggagcctcctgggagggttcaaaccatcagctctatgagaaatgcccagaaaggctttgccgactccatccgtctgtggaggctgcctgcctccggggtgggatgggtggtttctcctccaattcagacccaagaggtagcccccgagggcatgtacctggtgggaagcagctcaggtacccttgggggttgcagggcccttacgcaggtatttctctctctctcctctctggggtgcgtgtgtgcgtgcgcgtgtgcgtgcctatgcttttctctgtgggcacatcaggatgcccctcggagagcatgtgcacgtgtccccacctgagcgagcgtgtgtgtgtgctcctctgcgtcccaggtttggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaa

SEQ ID NO: 320102 - DNA, 3624 bp, Homo sapiens
ggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaaataagaaaactctaagcgaccccaacagccacctgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagcaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctcccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccaccgacggggactgctgagcctcctgggacagcgggctggcagggactggcaggaggcaggtgcagggaggcctggggcagcctcctgatggggatgtttggcctctgcttcctcccagttcacagccagagttgcctctcctcctcctcttccccaacccccagaccatgaccagccttagaaaatccatgtactctgttgttagagggcccagagttccttctccacccccgctctctctctcttggcctgagatctctgtgcaggaaccaagatggggctgaagcctctggaggcagttggttgggggcgggcaggcaggaggccctccctccacccccccaccctcagcccggcaacttctgggttccatgggttttagttccgttcttcgttttcttcctccgttattgatttctcctttctccctaagcccccttctgcttccacgcccttttcctctttgaagagtcaagtacaattcagacaaactgctttctcctgtccaaaagcaaaaaggcaaaggaaagaaagaaagcttcagaccgctagtaaggctcaaagaagaagaaaaacaccaaaaccacaagggaaaagaaaaacccagtttcttaggaaacgcaaacgatttattatccagattatttggataagtcctttttaagaaaaaaaaaagaaaatgaaaaacaacacaaaaaaaatagaaaactcttttcttgagtgtggatgagaatgggcacgctcacacttctggccagggtgaatgtgcctgtgtgtgtgtgtgtgtgtgtgtgtgtgtgtacatgtacgcgtgtgcattgaggagagagagactgaacagagagtacttgctgctaacgaatccatcttggactaaattctgacaaggcctcagtttccccagttgtgcagggagtaggtcagacagggttttcactgtctagatttagctggttagattttcctctaaaatcttaagcagatgctgaatccataaagccaaggagtgctgagggctggagtgggtgggccctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaa

SEQ ID NO: 320103 - DNA, 2602 bp, Homo sapiens
tccctcttggcactccaggcaaggcaggtgcccgcttccccaacacctccaggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctctcttgatggccaggaatccagaatctgcccttccccaaccttggtttctccttctgtaaagcagagtgatggctgagaagtcctctctagctgcagaagcctgagcttcccggtgtcagtcagctctgcaacgtgggagccttggaggcgggtggcctggctgtgcttcatatgcccaggagtggagaaggaggctgagaagctggtttcccagctctgatctccacaggcacctcctataaccctcctctcacccaccccgctacggtctgagagatctgaaataacctttcccagtgggcagggttgccagggttgaggggacagcacataccacccccacccaacctgttcgaggggccctgcatggcacgggatgagtccctgccctgtgcagctgcctggcagtggctgggacaaggatcttgcagccagcacagaggcctcttcaaaggcctctccctcttggcactccaggcaaggcaggtgcccgcttccccaacacctccaggcagtgaccctagggcatgccccagcaggtctccgagcagccactgggacccgtctcagcacatcctggcctttgaaagtctgatatcctgagaggagggcaggttttagggccgcagttccagccagcgtccccagcctggcttccctgccatggactcagtagctcgtggggcttcttaccacccaccagccccgctggggtgcggcctggctgtgggcaaaggaggacttgcctggagatttgagagaagattccttctaccagggctgctgaggggccaggcctgcatcaggggctaggctctggctgggcccggaggctgagactaaggctttcgaccctggtgcctccatgtggatgctgcctcagacaaaggcagtgagccttccctgccaaagtgcccatcccatgggctcggcctcactggtcactgttagcccatgaacacgtgtgggcctcggtcacgtggctttgagggcagtctgaccaggctagaccacacgtgccgtgacagggggtgccattcccctcgcaggctctaatgtgcccacatgtagcctggcagtccaaagaccaagaatcaacttgcaaatctgccattaaactgctgtgcgacttcaggcatatcactgccttctctgggcttcagtgtccttttcatacctagaagtctgcggtctgaggctctttgggttcagacacactgttctaggcttctgtaggggaccttgtgatctgccgtgcccctcctccctgttcttttctgtcctccccaccccaccctcagaagctgcttgctctgcccccaggacaggagcttgacggatgaagtgcagccagccacccaggtgccatttccagtctgacttccagaaatgtgcaccatgtcctagagcacagacccattggctggagcctcctgggagggttcaaaccatcagctctatgagaaatgcccagaaaggctttgccgactccatccgtctgtggaggctgcctgcctccggggtgggatgggtggtttctcctccaattcagacccaagaggtagcccccgagggcatgtacctggtgggaagcagctcaggtacccttgggggttgcagggcccttacgcaggtatttctctctctctcctctctggggtgcgtgtgtgcgtgcgcgtgtgcgtgcctatgcttttctctgtgggcacatcaggatgcccctcggagagcatgtgcacgtgtccccacctgagcgagcgtgtgtgtgtgctcctctgcgtcccaggtttggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaa

SEQ ID NO: 320104 - DNA, 315 bp, Homo sapiens
cacatttggagtggcagccagaaggccctccactgcactttcaccctggagaggcacagcttggcctccacagagctcacctgcaagatctgcgtgcggcaagtggaaggggagggccagatattccagctgcataccactctggcagaggtgagggaagtcggggccacatattccagctgcacaccacactggcggaggtgagggaagggtggggcagatattccagctgcacaccacgctggcggaggtgagggaagggtggggcagatattccagctgcacaccacgctggcggaggtgagggaagggtgg

SEQ ID NO: 320105 - DNA, 358 bp, Homo sapiens
ttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaatccgggttgcatttggctgtct

SEQ ID NO: 320106 - DNA, 5300 bp, Homo sapiens
ggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaaataagaaaactctaagcgaccccaacagccacctgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagcaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctcccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccaccgacggggactgctgagcctcctgggacagcgggctggcagggactggcaggaggcaggtgcagggaggcctggggcagcctcctgatggggatgtttggcctctgcttcctcccagttcacagccagagttgcctctcctcctcctcttccccaacccccagaccatgaccagccttagaaaatccatgtactctgttgttagagggcccagagttccttctccacccccgctctctctctcttggcctgagatctctgtgcaggaaccaagatggggctgaagcctctggaggcagttggttgggggcgggcaggcaggaggccctccctccacccccccaccctcagcccggcaacttctgggttccatgggttttagttccgttcttcgttttcttcctccgttattgatttctcctttctccctaagcccccttctgcttccacgcccttttcctctttgaagagtcaagtacaattcagacaaactgctttctcctgtccaaaagcaaaaaggcaaaggaaagaaagaaagcttcagaccgctagtaaggctcaaagaagaagaaaaacaccaaaaccacaagggaaaagaaaaacccagtttcttaggaaacgcaaacgatttattatccagattatttggataagtcctttttaagaaaaaaaaaagaaaatgaaaaacaacacaaaaaaaatagaaaactcttttcttgagtgtggatgagaatgggcacgctcacacttctggccagggtgaatgtgcctgtgtgtgtgtgtgtgtgtgtgtgtgtgtgtacatgtacgcgtgtgcattgaggagagagagactgaacagagagtacttgctgctaacgaatccatcttggactaaattctgacaaggcctcagtttccccagttgtgcagggagtaggtcagacagggttttcactgtctagatttagctggttagattttcctctaaaatcttaagcagatgctgaatccataaagccaaggagtgctgagggctggagtgggtgggccctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctctcttgatggccaggaatccagaatctgcccttccccaaccttggtttctccttctgtaaagcagagtgatggctgagaagtcctctctagctgcagaagcctgagcttcccggtgtcagtcagctctgcaacgtgggagccttggaggcgggtggcctggctgtgcttcatatgcccaggagtggagaaggaggctgagaagctggtttcccagctctgatctccacaggcacctcctataaccctcctctcacccaccccgctacggtctgagagatctgaaataacctttcccagtgggcagggttgccagggttgaggggacagcacataccacccccacccaacctgttcgaggggccctgcatggcacgggatgagtccctgccctgtgcagctgcctggcagtggctgggacaaggatcttgcagccagcacagaggcctcttcaaaggcctctccctcttggcactccaggcaaggcaggtgcccgcttccccaacacctccaggcagtgaccctagggcatgccccagcaggtctccgagcagccactgggacccgtctcagcacatcctggcctttgaaagtctgatatcctgagaggagggcaggttttagggccgcagttccagccagcgtccccagcctggcttccctgccatggactcagtagctcgtggggcttcttaccacccaccagccccgctggggtgcggcctggctgtgggcaaaggaggacttgcctggagatttgagagaagattccttctaccagggctgctgaggggccaggcctgcatcaggggctaggctctggctgggcccggaggctgagactaaggctttcgaccctggtgcctccatgtggatgctgcctcagacaaaggcagtgagccttccctgccaaagtgcccatcccatgggctcggcctcactggtcactgttagcccatgaacacgtgtgggcctcggtcacgtggctttgagggcagtctgaccaggctagaccacacgtgccgtgacagggggtgccattcccctcgcaggctctaatgtgcccacatgtagcctggcagtccaaagaccaagaatcaacttgcaaatctgccattaaactgctgtgcgacttcaggcatatcactgccttctctgggcttcagtgtccttttcatacctagaagtctgcggtctgaggctctttgggttcagacacactgttctaggcttctgtaggggaccttgtgatctgccgtgcccctcctccctgttcttttctgtcctccccaccccaccctcagaagctgcttgctctgcccccaggacaggagcttgacggatgaagtgcagccagccacccaggtgccatttccagtctgacttccagaaatgtgcaccatgtcctagagcacagacccattggctggagcctcctgggagggttcaaaccatcagctctatgagaaatgcccagaaaggctttgccgactccatccgtctgtggaggctgcctgcctccggggtgggatgggtggtttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaa

SEQ ID NO: 320107 - DNA, 3537 bp, Homo sapiens
ggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaaataagaaaactctaagcgaccccaacagccacctgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagcaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggggtcagcttgctggtgcccaatggagccattccccagggcaagttctacgagatgtatctactcatcaacaaggcagaaagtaccctcccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccaccgacggggactgctgagcctcctgggacagcgggctggcagggactggcaggaggcaggtgcagggaggcctggggcagcctcctgatggggatgtttggcctctgcttcctcccagttcacagccagagttgcctctcctcctcctcttccccaacccccagaccatgaccagccttagaaaatccatgtactctgttgttagagggcccagagttccttctccacccccgctctctctctcttggcctgagatctctgtgcaggaaccaagatggggctgaagcctctggaggcagttggttgggggcgggcaggcaggaggccctccctccacccccccaccctcagcccggcaacttctgggttccatgggttttagttccgttcttcgttttcttcctccgttattgatttctcctttctccctaagcccccttctgcttccacgcccttttcctctttgaagagtcaagtacaattcagacaaactgctttctcctgtccaaaagcaaaaaggcaaaggaaagaaagaaagcttcagaccgctagtaaggctcaaagaagaagaaaaacaccaaaaccacaagggaaaagaaaaacccagtttcttaggaaacgcaaacgatttattatccagattatttggataagtcctttttaagaaaaaaaaaagaaaatgaaaaacaacacaaaaaaaatagaaaactcttttcttgagtgtggatgagaatgggcacgctcacacttctggccagggtgaatgtgcctgtgtgtgtgtgtgtgtgtgtgtgtgtgtgtacatgtacgcgtgtgcattgaggagagagagactgaacagagagtacttgctgctaacgaatccatcttggactaaattctgacaaggcctcagtttccccagttgtgcagggagtaggtcagacagggttttcactgtctagatttagctggttagattttcctctaaaatcttaagcagatgctgaatccataaagccaaggagtgctgagggctggagtgggtgggccctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaa

SEQ ID NO: 320108 - DNA, 2685 bp, Homo sapiens
gattgtggtttgggatcggcatgtgcccactactgtatatggaatggatagatcagtggtaacctggtctatagcacagggcatgaaagccctcgacatgaatcatatcgagggcctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctctcttgatggccaggaatccagaatctgcccttccccaaccttggtttctccttctgtaaagcagagtgatggctgagaagtcctctctagctgcagaagcctgagcttcccggtgtcagtcagctctgcaacgtgggagccttggaggcgggtggcctggctgtgcttcatatgcccaggagtggagaaggaggctgagaagctggtttcccagctctgatctccacaggcacctcctataaccctcctctcacccaccccgctacggtctgagagatctgaaataacctttcccagtgggcagggttgccagggttgaggggacagcacataccacccccacccaacctgttcgaggggccctgcatggcacgggatgagtccctgccctgtgcagctgcctggcagtggctgggacaaggatcttgcagccagcacagaggcctcttcaaaggcctctccctcttggcactccaggcaaggcaggtgcccgcttccccaacacctccaggcagtgaccctagggcatgccccagcaggtctccgagcagccactgggacccgtctcagcacatcctggcctttgaaagtctgatatcctgagaggagggcaggttttagggccgcagttccagccagcgtccccagcctggcttccctgccatggactcagtagctcgtggggcttcttaccacccaccagccccgctggggtgcggcctggctgtgggcaaaggaggacttgcctggagatttgagagaagattccttctaccagggctgctgaggggccaggcctgcatcaggggctaggctctggctgggcccggaggctgagactaaggctttcgaccctggtgcctccatgtggatgctgcctcagacaaaggcagtgagccttccctgccaaagtgcccatcccatgggctcggcctcactggtcactgttagcccatgaacacgtgtgggcctcggtcacgtggctttgagggcagtctgaccaggctagaccacacgtgccgtgacagggggtgccattcccctcgcaggctctaatgtgcccacatgtagcctggcagtccaaagaccaagaatcaacttgcaaatctgccattaaactgctgtgcgacttcaggcatatcactgccttctctgggcttcagtgtccttttcatacctagaagtctgcggtctgaggctctttgggttcagacacactgttctaggcttctgtaggggaccttgtgatctgccgtgcccctcctccctgttcttttctgtcctccccaccccaccctcagaagctgcttgctctgcccccaggacaggagcttgacggatgaagtgcagccagccacccaggtgccatttccagtctgacttccagaaatgtgcaccatgtcctagagcacagacccattggctggagcctcctgggagggttcaaaccatcagctctatgagaaatgcccagaaaggctttgccgactccatccgtctgtggaggctgcctgcctccggggtgggatgggtggtttctcctccaattcagacccaagaggtagcccccgagggcatgtacctggtgggaagcagctcaggtacccttgggggttgcagggcccttacgcaggtatttctctctctctcctctctggggtgcgtgtgtgcgtgcgcgtgtgcgtgcctatgcttttctctgtgggcacatcaggatgcccctcggagagcatgtgcacgtgtccccacctgagcgagcgtgtgtgtgtgctcctctgcgtcccaggtttggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaa

SEQ ID NO: 320109 - DNA, 753 bp, Homo sapiens
agggaggaacctcggcatgtagctggtgtttatcggacgaggcgcgtctagcgacatgcgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggc

SEQ ID NO: 320110 - DNA, 461 bp, Homo sapiens
gcggccgcctactactactaaattcgcggccgcgtcgacgctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggc

SEQ ID NO: 320111 - DNA, 399 bp, Homo sapiens
ggaaaggggaggggaaacaaagaccacacaggaaacaggagagaaaggaagaggaagtggaaagacgcaaaaaagggaaaagggcccaaagggcaaagaaaacggcaggaggatcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggc

SEQ ID NO: 320112 - DNA, 403 bp, Homo sapiens
  misc_feature (3)..(3): n is a, c, g, or t
ggncattgtgccctgccaaggcacagcgtagatctggaaagagcagaatgctttccttttcagatgtggctggtcatggaaggggcagttgtccaagttgggctgggtcttggtacatcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggc

SEQ ID NO: 320113 - DNA, 456 bp, Homo sapiens
cttttttttttttgtttccacgaagggggccccaaaggtaaaaaagttttgtgtggtaacactccccccaagggaaatggggcctgtgcaaattccgccgcatttccctaaaaattaaataatttttggcaaaaaaaccctatccgccttgtaaccgcgctttttctttggggaaatcctggtttcaggacaccaaagggttaaaaaaggtttggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggc

SEQ ID NO: 320114 - DNA, 864 bp, Homo sapiens
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggc

SEQ ID NO: 320115 - DNA, 816 bp, Homo sapiens
tgtcgactcggtgatggtatcgcagcgggtctctctatctagccagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggc

SEQ ID NO: 320116 - DNA, 824 bp, Homo sapiens
tggccccggggataatttttatgtgggatttcgtcgaccacgcgtcgctagcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggc

SEQ ID NO: 320117 - DNA, 687 bp, Homo sapiens
gcaggccgcggtggggtggggcggcgaaggccggaagggataaaaccgcagtccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggc

SEQ ID NO: 320118 - DNA, 798 bp, Homo sapiens
catccccaaaggcttcttatgataatgagaagcatgattataactgtctaactcttctgcgttcatattgatgttaatgggactaaattaccttgctagcttaatgagataagattttaaatgggtgttttatgtactctgtgtgtgtgtatttaatgaagacttggtggtcgcttctgatttacacttgggaatcaattcccctcttgccgccgttcctaggaacggcggcaagagagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggc

SEQ ID NO: 320119 - DNA, 1010 bp, Homo sapiens
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaaaaaacaaaaaaaaaaaaaaaacaggggggcacaaaatacccgaggcaacacacaggcccacatttgaaaaaaggcccaaaggtgtaaaacgcaacgggcgggtaacacgcgaggagaagcggaactggacaccactgg

SEQ ID NO: 320120 - DNA, 992 bp, Homo sapiens
  misc_feature (946)..(946): n is a, c, g, or t
  misc_feature (953)..(953): n is a, c, g, or t
  misc_feature (955)..(955): n is a, c, g, or t
  misc_feature (963)..(965): n is a, c, g, or t
  misc_feature (970)..(970): n is a, c, g, or t
  misc_feature (981)..(981): n is a, c, g, or t
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaaaaaacaaaaaaaaaaaaaaaaaaaaaaaaaaaaaaaaaaaagggggggcgcgcaaaaaattctccccggggggngcccaantnaggacccnnnttttngaaaagggggncccaaaagggg

SEQ ID NO: 320121 - DNA, 1204 bp, Homo sapiens
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaccacaccaccaccacaccccccaccccacccaccaccacggcgggcccccccacaacaacacccccccgaggcgcccccgcccacgccccccgccccgccccccaaggcgcccacaagcgacgcgccaacaacacaccccggccccgctgtacacaccccgacaacggtgccaccgcctcccgcgacccccgggcacagaaccccccctccgggagccaccacacgggccacccctccccgcctcacaccccagcgcaaccacacaccgcggactaccgcgcccacacccgccaaccgcccccgcacacccgcacgagccccccgcactccacg

SEQ ID NO: 320122 - DNA, 969 bp, Homo sapiens
  misc_feature (923)..(923): n is a, c, g, or t
  misc_feature (930)..(930): n is a, c, g, or t
  misc_feature (932)..(932): n is a, c, g, or t
  misc_feature (940)..(942): n is a, c, g, or t
  misc_feature (947)..(947): n is a, c, g, or t
  misc_feature (958)..(958): n is a, c, g, or t
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaaaaaaaaaaaaaaaaaaaagggggggcgcgcaaaaaattctccccggggggngcccaantnaggacccnnnttttngaaaagggggncccaaaagggg

SEQ ID NO: 320123 - DNA, 1018 bp, Homo sapiens
  misc_feature (1018)..(1018): n is a, c, g, or t
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccactctgattaatagtggcttgggagaaaacaaaaaaagggccggataattccggagggccaacttccgtcccttcttatcaagggcctagcgggataaagcaaaggcggtaaaggcgagggaccgcggattgagacattcgggggaagcacaccaaccgaaagtgattgcccctgggactaan

SEQ ID NO: 320124 - DNA, 846 bp, Homo sapiens
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccacgtccccgcatcaacgccactaagcactccgctggcccttgttcccagcaaggggtctgcacctccttctccttctggctccacagccccctgtcggggcctccacccccttctcgatcacaaattcctcgcct

SEQ ID NO: 320125 - DNA, 685 bp, Homo sapiens
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacacccccacctcctgcaataaaatagtagcatcggc

SEQ ID NO: 320126 - DNA, 807 bp, Homo sapiens
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggc

SEQ ID NO: 320127 - DNA, 441 bp, Homo sapiens
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggaggtcaaaatgtaattaaccatctccccgagcgtttgctccattttccctcagtgggaggcgatccatggttcgcgcactggcttgtgggccaacacccccaaagcaaactgagggccttgtggtgaaaccgcatccc

SEQ ID NO: 320128 - DNA, 118 bp, Homo sapiens
tcagcaaggggctctgccctccctccttccttcttgcttctcatagccccggtgtgcggtgcatacacccccacctcctgcaataaaatagtagcatcggcctccctctgagttcttg

SEQ ID NO: 320129 - DNA, 864 bp, Homo sapiens; identical to SEQ ID NO: 320114

SEQ ID NO: 320130 - DNA, 687 bp, Homo sapiens; identical to SEQ ID NO: 320117

SEQ ID NO: 320131 - DNA, 952 bp, Homo sapiens
  misc_feature (842)..(842): n is a, c, g, or t
tgtcgactcggtgatggtatcgcagcgggtctctctatctagccagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaaaaaacaaaaaaaaaaggngggcggaaaaaacaccagggggcccataacacaccgttttgaaaagggccaagggaaaaaaaagagagggcggaaaagggagggaaagctggttgggacgccctcggggg

SEQ ID NO: 320132 - DNA, 750 bp, Homo sapiens
tggccccggggataatttttatgtgggatttcgtcgaccacgcgtcgctagcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgctgactctgagaagaccgaggacgagggggcttgtgtcgggcgctgcttcctcttcttctggtctatagccgtt

SEQ ID NO: 320133 - DNA, 820 bp, Homo sapiens
  misc_feature (35)..(35): n is a, c, g, or t
  misc_feature (47)..(47): n is a, c, g, or t
cacgcgtcgccacgcgtcgcggacgcgtgggtcgnccacgcgtccgncagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggc

SEQ ID NO: 320134 - DNA, 786 bp, Homo sapiens
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggc

SEQ ID NO: 320135 - DNA, 786 bp, Homo sapiens; identical to SEQ ID NO: 320134

SEQ ID NO: 320136 - DNA, 1000 bp, Homo sapiens
  misc_feature (890)..(890): n is a, c, g, or t
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaaaaaacaaaaaaaaaaggngggcggaaaaaacaccagggggcccataacacaccgttttgaaaagggccaagggaaaaaaaagagagggcggaaaagggagggaaagctggttgggacgccctcggggg

SEQ ID NO: 320137 - DNA, 1313 bp, Homo sapiens
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggcaaaaaaaacaaaaaacaaaaaaaaaaaaacaaaaaaaaaaaaaaaaaaaaaaaaaaaaaaaaaaaaaaaaaaaaaaaaaaaaaaaaaaaaaaaaaaaaaaaaacctcgggggggggcccggtcccaaattgcccctatagggggtcgttttacaattaacgggccgtggtttaaaaacgtcggaacgggaaaaaccctggggttcccaaactaaatcgcctggcagcaaatccccttttggccagttggcgtattagcaaaaaggccccaaccgttcgcctttccaaacagtggcccagcctaaatggcaaatggcaaattgaaagcgtaaatttttggtaaaaattcgcgttaaattttgtgaaaaccagcttatttttaaaccaatagcgccaaattgggcccaattttggaacaagagccccttttttaagaacgggggcctcaac

SEQ ID NO: 320138 - DNA, 852 bp, Homo sapiens
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaagggagcttttggccctacattaactttctttttgggtttcaaaaaaaccccccggaggggctggaggcattaaacccctaaa

SEQ ID NO: 320139 - DNA, 676 bp, Homo sapiens
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggc

SEQ ID NO: 320140 - DNA, 682 bp, Homo sapiens
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggcaccctgatgaaaagactgaggaaaatgctgcctttcctgaatggctaccaggcagggaatga

SEQ ID NO: 320141 - DNA, 842 bp, Homo sapiens
atgacccaaaacttttatctataaaaagaaactgacaaatagtcaatcataacttggtgttggaaactgacctaagccaatttgcttatacacagcatccaagttatgtctagaaactgctggattatctaagttttaggtgggtatcgttcagctgctccccgcagacttacgagctagtgatagtgaaaatacatttcatgataaatgctgctgtacatacagatatgtatttattatctatttactagttatttttattatttattattatctatgatttattagtaatcaggcacaaaacagctctactatcctagtttctaagcctaatgaagttccagctgtctctttaggcactccaccacatctcgcaggaagagtttactcaaggtgcgtcacaacgtggatgtgactactccaggggcaaaattttgtccttactgtgaaccatcctctaacctagtgactggacatgctatttcagagttaagcctcaggcatcaccctagggccttgctagataaagtctttcaccttgcttatgtaggagtagggagtagttagcagtgagggaccttttctaacctgctattctaacaagccactgtagcgctcattatttttaatagccagtcttcatactgatcagtgataaaattaacaaaagagcttgtagtaggcagttctgcaatgtgacatttctgattagaatgctcactgcatctagagggttcctttctgtgcttcagacttatacagtgtttgtggattattctaaagtgagttacactgttgtactgaaacaatcattctattgagtcataaactaccggaaaaaa

SEQ ID NO: 320142 - DNA, 992 bp, Homo sapiens
gttttcttactgcgttcatggatgcatgaaaacaatggtatctgtcaggcctttgtttctttcgttgtaccattaagtgaggtttttaaaaagagggttttcatcatttataatgtgttaatacagtagaattctttttttgaaggacaacattgaaagtcttttcagacaaatatttaatacactaattacatagctaaacttttgtcatattaaagatacctcttttctgcatgtgcattgtactaggaaaaaagtacacactgtcttaaaatttgcccaagtcatctgtgatgtatgtgatcagtggcctgaaactgtttgcagttactttaaaaatgtataaatgtgtgtaaataaaaagattacttaataggatgaatgaatacatgcccacagaagccaattcagcaaaattaaatgtcaaggagtaaacatagattgctttgtgtttagagagttatttgttaattagagttcatagacttgattcatgccttttgggatctttattagagcacgtctgacatgttttacccatgtattttggtaaatacacagcttgctcatgtgttcttatggaaatttcttttagtgatcacttgtaatagctgccacttagtaggcactcagtaagtgcataataagtggatgtgttcccacatacttcagacttgtagtcagtctttttgtattgtcgatcagcatgactttctcaatctcaggtagtctgtatttagcctacatttttttggaaattatgctcataaaggtaattttaccatccatcccagggtagtttcctcacttctaatccttccaacctctccatagcatgggagactttagaactaaattatttgtccatgcatttattcattcaataaattaataaagacattgtatcattttcagggccattttatctgtagtctgctttcgtttttctgctttctcttcctttttgtgtctgatattgtctctcacccttg

SEQ ID NO: 320143 - DNA, 1395 bp, Homo sapiens
ttccagcactgtcacaccaggcagggaacctgagcagaacattcactgccaagattactgtgagcaagtaggaagtaatgcacacaccaagtgctgccacagcaaaagcaggtgctctaggatgggtagtggctgctctgcttaaaagtgggatgcccttactgggtgcgatggctcacacctataatcccagcattctgggaggctgaggcaggcagatcacctgaggtcaggagttcgagaccagcctggacaacatggtgaaaccccatctctactaaaaatgcaaacattagctgggcgtgatggtgggcgcctgtaatcccagctactcgggaggctgaggcaagagaatcgcttgaacccaggagatggaggttgcagtgagccaagatcgcgccactgcactgcaacctgggcgacagaccgagactccgtctcaaaacaacaacaacaacaacaacaacaaaaaaacctgggatgccctagagagagggtgtctgcctggggtcccccataaaaagactgcttttagcctgtctagagtgagagaagaccccagaggaggcagaggataccatcagaatgccctcaggtgctgtttgcaaggaacagcctccccatatatgtcgtatttattttggcaataggagtattgggtaggagaggaaaaaacagtgcaaacctcctttgtgcaacttccagaatctcgtctttggagggctgttcccgtgacacgagtggggcgcctcccccaccactaaaacagaagtgaatgaaattggtgcttgtgcgccccctcctggcaaaatgcggctgtgcgtccaggatgcctggatcttccctgtggcccaggactgcaggaggcgttctgagctgtggccctcttaccaggggtggagcctctggggctgctgaaccagctgtagggatggtgctgctgttcttcctggcatccatcctaggcatcttcatacctcccactttatccctgctgtttcctgattcaagggctgccccattatacaagttctggtctcctcagtggggacaataagaaaaacatttgattcgataacatataaaccactagtgtgagattcatgcagcatcataggaaggggggtgatgtgtttgcagtgagcaggctaatgtattaatctgctaattctgtctcctgagttttctctcttttcctccctcctgccacatgaagtgtgcttggcttcttacctaccataattagacatcttttcttcctcagaaggccgcggatggatggagtatccgcaactcagcgatttagccgatatggccgggtacccaggaccgcggtcaccgggacccaccataatgccccctgcccaagggggtagggaagggacctgggggccg

SEQ ID NO: 320144 - DNA, 4136 bp, Homo sapiens
cgggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccggaaaaaaaaaaaag

SEQ ID NO: 320145 - DNA, 4157 bp, Homo sapiens
cgggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgaggctgaattgcatcatcagcagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccggaaaaaaaaaaaag

SEQ ID NO: 320146 - DNA, 3678 bp, Homo sapiens
cgggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgccctggtgtcctgggttttcgtgatgatctttgctctgtttccagtggggtttgaagcagagttcagggaaccctgcccaaggtcctcctgttcagacattcctatgttgaataaagtatgtttgacttccccggaaaaaaaaaaaag

SEQ ID NO: 320147 - DNA, 3471 bp, Homo sapiens
gtggatttgttaatttgtcagctcctgggcttgtgatgcctactgagttacattccccacatagaaagtcgttgctctttaataagccaagttaaaggcagtgacctacatttgttgtgccttggattggtggtaagattgaacatatatagaaaagctaaactattttctcaggtttctttttaggttgaagctaaataaaagtgaatgttagtaactagaactctaatttcttgtaatttggaaaaaagaaaccattctagccagaggaagaaaaagacaattccctggcaactcttttcagaaagctatgcctctttgccattcataccctgagatctaaaactggtgttaaaaggatccctcgcttgttccttttctccccaaaggttctgaggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccggaaaaaaaaaaaag

SEQ ID NO: 320148 - DNA, 1778 bp, Homo sapiens
acccccccgactagcccgacagccaaactgcctccctcacagccaaaccaccacgctgactgtacctctccctcacggccaaactgccacgaggaccgttcctctccctcacagccaaactaccttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccggaaaaaaaaaaaag

SEQ ID NO: 320149 - DNA, 3485 bp, Homo sapiens
ttccagcactgtcacaccaggcagggaacctgagcagaacattcactgccaagattactgtgagcaagtaggaagtaatgcacacaccaagtgctgccacagcaaaagcaggtgctctaggatgggtagtggctgctctgcttaaaagtgggatgcccttactgggtgcgatggctcacacctataatcccagcattctgggaggctgaggcaggcagatcacctgaggtcaggagttcgagaccagcctggacaacatggtgaaaccccatctctactaaaaatgcaaacattagctgggcgtgatggtgggcgcctgtaatcccagctactcgggaggctgaggcaagagaatcgcttgaacccaggagatggaggttgcagtgagccaagatcgcgccactgcactgcaacctgggcgacagaccgagactccgtctcaaaacaacaacaacaacaacaacaacaaaaaaacctgggatgccctagagagagggtgtctgcctggggtcccccataaaaagactgcttttagcctgtctagagtgagagaagaccccagaggaggcagaggataccatcagaatgccctcaggtgctgtttgcaaggaacagcctccccatatatgtcgtatttattttggcaataggagtattgggtaggagaggaaaaaacagtgcaaacctcctttgtgcaacttccagaatctcgtctttggagggctgttcccgtgacacgagtggggcgcctcccccaccactaaaacagaagtgaatgaaattggtgcttgtgcgccccctcctggcaaaatgcggctgtgcgtccaggatgcctggatcttccctgtggcccaggactgcaggaggcgttctgagctgtggccctcttaccaggggtggagcctctggggctgctgaaccagctgtagggatggtgctgctgttcttcctggcatccatcctaggcatcttcatacctcccactttatccctgctgtttcctgattcaagggctgccccattatacaagttctggtctcctcagtggggacaataagaaaaacatttgattcgataacatataaaccactagtgtgagattcatgcagcatcataggaaggggggtgatgtgtttgcagtgagcaggctaatgtattaatctgctaattctgtctcctgagttttctctcttttcctccctcctgccacatgaagtgtgcttggcttcttacctaccataattagacatcttttcttcctcagagaaggcatgagacagggatttgattgtagttatcactgtaaacatcaaactgatttttatgcagaactattgccccagggcataccttccaaggaacctggtctctccttacctagcgaattccacatacacatagatgtacacctacctgtacactcacagattgggtggtgattaaagggacagaatcggggaccagcttcttgttaggaatgcagtgttgccacggcatgacagcatggagcagttgagggaatggctgcccaggagaactcagaactcttgaaatgtagttccaggctgccatcattgccctgatattcaggccgtcagacagatgtgtgttgtaggccctgaacggcacagagagtggcagaacaggctacataaacagctcagcccagaattgtctttccagactgcctgccctcagtcacaacccccaccagggaagggaagcggccccaagactccttcctccttcacccactcgaggaaacagagttcctgttacgtggcatgaatgatgtcttttggccccagttaatccctctgagtcaccaggtggcctttgccaagtgctggagctggaagagatgatagagacactcatctggcgtcctgaggctctcctcacagctgttgaattctagagggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccggaaaaaaaaaaaag

SEQ ID NO: 320150 - DNA, 1979 bp, Homo sapiens
agcaaacagaggtgcttgcccagtgtctctggaggggcttcccttagaggtgggctgtgtgatcccctgccaggagggggcgatgggggccacttgttcattaacgatgttaggctcaaggtaactgaactttttttgcacatgcctctctgcagagagttgtgcataaacacactgctcggcaggacagagcaagattgggaactgagggcaaatcccttcctccgtgcgtcgaactcttgatcccaggccttaaaagtgggatctctgcactctgggctttctctagcttccccagggaagggaggctcggggtgaggtgggcacggggcatctttcctgcccaactgtgaagtcctaaaaagcttcacaaagtttctattgaatgacagctttcttcttctctttctccagggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccggaaaaaaaaaaaag

SEQ ID NO: 320151 - DNA, 1304 bp, Homo sapiens
ggtgacttagaggatcccccccgactagcccgacagctcgcgaacgtgttatccccccgccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccggaaaaaaaaaaaag

SEQ ID NO: 320152 - DNA, 3169 bp, Homo sapiens
cgggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactggtgaggggcagtggggcagggcgggcatgggggtggatgtgtccttagctgcggtgagagggcagcttttctcccacacacagccctgcagctctgtgcaggaaagatgagctggccctgcactagcttcacctcaggacaccccagcaccggcattgccacagagtttcggaaaatggtcacagaaaagcacagctcagccttccctaggctctagggagatgtccctggtgagtggtgtcaggtcccgctccctgcctttagctgtccccagtgctcctgattttggcttaaaggggctgctggggtcttagggtttctggttttctctctgatgtgtaactcttctgtcttcagaacagtggaagcagctctggaatgtatgttaagtgcaggaaaggctagaacacgctgcaccccagctttatcctctttgttctgtcattgtgccaggggtctttgagttggacccctggcagctccattgtggaccggagggattcctggctctatagggtggaggtcggtacactcacgcagcttcttcacatgggcaggtttggggtggttctgtttgttttctttaatgaagcttgtg

SEQ ID NO: 320153 - DNA, 2205 bp, Homo sapiens
cgggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttggtaggtgtatttctattgctaaaagttactag

SEQ ID NO: 320154 - DNA, 1606 bp, Homo sapiens
  misc_feature (1577)..(1577): n is a, c, g, or t
cgggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgaggtaatgtttaagttacatctgcattgaactgaaattttataatttcccaagcattcattatgaaaattatgatctggaagtcttttatccatgnaatttatcaaaaggaagtagagaagttat

SEQ ID NO: 320155 - DNA, 2140 bp, Homo sapiens
ttccagcactgtcacaccaggcagggaacctgagcagaacattcactgccaagattactgtgagcaagtaggaagtaatgcacacaccaagtgctgccacagcaaaagcaggtgctctaggatgggtagtggctgctctgcttaaaagtgggatgcccttactgggtgcgatggctcacacctataatcccagcattctgggaggctgaggcaggcagatcacctgaggtcaggagttcgagaccagcctggacaacatggtgaaaccccatctctactaaaaatgcaaacattagctgggcgtgatggtgggcgcctgtaatcccagctactcgggaggctgaggcaagagaatcgcttgaacccaggagatggaggttgcagtgagccaagatcgcgccactgcactgcaacctgggcgacagaccgagactccgtctcaaaacaacaacaacaacaacaacaacaaaaaaacctgggatgccctagagagagggtgtctgcctggggtcccccataaaaagactgcttttagcctgtctagagtgagagaagaccccagaggaggcagaggataccatcagaatgccctcaggtgctgtttgcaaggaacagcctccccatatatgtcgtatttattttggcaataggagtattgggtaggagaggaaaaaacagtgcaaacctcctttgtgcaacttccagaatctcgtctttggagggctgttcccgtgacacgagtggggcgcctcccccaccactaaaacagaagtgaatgaaattggtgcttgtgcgccccctcctggcaaaatgcggctgtgcgtccaggatgcctggatcttccctgtggcccaggactgcaggaggcgttctgagctgtggccctcttaccaggggtggagcctctggggctgctgaaccagctgtagggatggtgctgctgttcttcctggcatccatcctaggcatcttcatacctcccactttatccctgctgtttcctgattcaagggctgccccattatacaagttctggtctcctcagtggggacaataagaaaaacatttgattcgataacatataaaccactagtgtgagattcatgcagcatcataggaaggggggtgatgtgtttgcagtgagcaggctaatgtattaatctgctaattctgtctcctgagttttctctcttttcctccctcctgccacatgaagtgtgcttggcttcttacctaccataattagacatcttttcttcctcagagaaggcatgagacagggatttgattgtagttatcactgtaaacatcaaactgatttttatgcagaactattgccccagggcataccttccaaggaacctggtctctccttacctagcgaattccacatacacatagatgtacacctacctgtacactcacagattgggtggtgattaaagggacagaatcggggaccagcttcttgttaggaatgcagtgttgccacggcatgacagcatggagcagttgagggaatggctgcccaggagaactcagaactcttgaaatgtagttccaggctgccatcattgccctgatattcaggccgtcagacagatgtgtgttgtaggccctgaacggcacagagagtggcagaacaggctacataaacagctcagcccagaattgtctttccagactgcctgccctcagtcacaacccccaccagggaagggaagcggccccaagactccttcctccttcacccactcgaggaaacagagttcctgttacgtggcatgaatgatgtcttttggccccagttaatccctctgagtcaccaggtggcctttgccaagtgctggagctggaagagatgatagagacactcatctggcgtcctgaggctctcctcacagctgttgaattctagagggttgagttccagaataaattctacagcgggaccggtttcaagttcttacccttctccttcgagcatattcgggaactcaacccagtgtaagcgcagtgcgtggagaaggccgagagccctccatgatcaggaggatgccacggtcagggtgcaaaggcagtgaagaagaagacgccaacctcccacatgctcatcaccggatgggatcctctaaatcgg

SEQ ID NO: 320156 - DNA, 627 bp, Homo sapiens
  misc_feature (393)..(393): n is a, c, g, or t
aggatttccctgtgcatggtggtgaaatcatgtagggaaaaaaaaattcaccgtgtaatctctttagaagtcacaaaagaaaaagaaggttatcttgctcccaaaaggctgtaaaaagaataagtaaagtggccatagaggcctagtcttctcaggacagtgtccgggttgagagtctgtctcctgaagcgcactctggggaaaatcccttcctgccctcctgcaggtccttagggtcccagacccagacagtcactttctcaacagagtgccgtcaactcagcacacactcctctcttgagcacagagccccagagggagaagaacaaatgtgttgaaaagaatcttattaagatgtagttaattaaaatgtaatgtattgaggggaatggnaggtgtcccaggtgagggctaagtcaggcaggatttttggggaaggcattgccgaaatcaccacctgagctcaacactgggtgcttctggcccctccagagttgaggtgccatccatgggaagtgcagtcccctgccctggcccaggttcaaagcgccaagtagccacaactcagaatgcctgcacgttcccctcctagccttatatcttctctctggtttcctcccacgacag

SEQ ID NO: 320157 - DNA, 444 bp, Homo sapiens
aaaaccaacaagtttacctatggctttcagaacatagtagatgcttatggaattggaacttaccgagagataaatccaggtaaaaaaaagcttgttatctttttcctctagagttttttttgtttgtttggttggtttggtttgttttgagacagagtctccctctgtcacccaggctggagtgcagcagcacgactgtagttcactgcagcctcaaactcctggcctcaagagatcctcccaactcagtctcctgtatagctaggaccacaggcgcacagcaccacacctggctaattttttattttatgatttttttttgactgggtctcattctgttgcctaggctgtagtgcaatggtgaaatcacggcttacagcagcctcaacctcgtgggctcaagtgattctcccgcctgaacctctggagtagctgggactacag

SEQ ID NO: 320158 - DNA, 408 bp, Homo sapiens
  misc_feature (396)..(396): n is a, c, g, or t
ctttctgagattatttaaattagataagttaagaaacttcgatgttcttatattccaggttccgagcctcactctatccctgtcctgagacaccacaggagaggaaggaaatggcttctggagtgaataccaggattgatgatctccaaatggtatgcagaaggctggagggaatttgtttttgtgaaatactggaatacgagaccattatccttccttgaaatgctgatattctataaggtacctgtagcaaaccaggataccaaaaaaagaaatgtacatgggtaatatgtccttctgggagctgagaaagtatcagggaatgatggttaaaaatagcattagccatcctcaaacgagacaggaatgtaaagcatctagaatcgttgttgcctnagcatattctca

SEQ ID NO: 320159 - DNA, 348 bp, Homo sapiens
  misc_feature (14)..(14): n is a, c, g, or t
  misc_feature (68)..(68): n is a, c, g, or t
tgattgtgtgtttngtgtgtttaatttttctttttgtcattttggatccctcagtctcagctgctagntctctcctctttatttttcccctcccattttattgaagagacaagatagctacagtaatttattttggggtcagtttctggacccttgttgtttccctctcttgttcaaaaataatgtgactttttccctgtcatggtagtgaagagacgcttcgggggaaccctgttctacagctgaacccagccctccctggagtgtttggtggaccatacccttttggcattgatccagtaagaggacttccttcctatatgctaacctcaaattttttaacactaa

SEQ ID NO: 320160 - DNA, 2148 bp, Homo sapiens
ggggaggcggtggttggggtggaacagttgtttgattttacttagccgttcagtcagtgggttttgtttttgttgttagacatatgcttttctgaggtttgtgttactaaccatcgcccttcccacctcacagaatgtcatgttaaagcccaggcaaattctactctttctgttcatctgtgtagggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccggaaaaaaaaaaaag

SEQ ID NO: 320161 - DNA, 725 bp, Homo sapiens
cgggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgaggtcagactattgtttcttttagtatttgagcagctgatattatactcacacaagtgggccatatttttattccagtaattattttaatttgctagtttggaagcaatgccatttttgcaccctgttttagtta

SEQ ID NO: 320162 - DNA, 4009 bp, Homo sapiens
cgggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccagctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccggaaaaaaaaaaaag

SEQ ID NO: 320163 - DNA, 3970 bp, Homo sapiens
  misc_feature (3907)..(3907): n is a, c, g, or t
cgggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctcttagcctccatccatccagacagcccttcccacctcctggtggtgagccagtctgcatttccacggcatnccaaagcccttttcatcttccccgtgcattgtagatggaaggagcacccatggccattcacat

SEQ ID NO: 320164 - DNA, 3964 bp, Homo sapiens
cgggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccggaaaaaaaaaaaag

SEQ ID NO: 320165 - DNA, 1425 bp, Homo sapiens
cgggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttgggctccggcgtgtgcaggggataactctagagtc

SEQ ID NO: 320166 - DNA, 780 bp, Homo sapiens
gttgttatttatttgtgaaccactggctgacagggtatcagagtgatacttactacttgcatattttcagtgctcatctctcagagatctagaacttgcctaccaagtacatggccttttaaaaaccggagacaactggaaattcattggacctgatcaacatcgtaatttctattagtaagtgtgttggaaacatatccttttgcatgagttaccagattctgcaagtgggaggctgttgatgtcccttcatacctcacctctggtttcaggcaacatgccaatgatctaataggacatgttaattgagcacttaggaattaaagcagtggtaaaactgccagatttgaaagactagtttgtgtcctttaagggttttttttttttttttttgcaacactgtaaaatccacatatctttttcctctaccccctctcattttacattttcaaattgttatagcagggtgagccctgaagatttcctttcacctcccttgcttttgtattcaaagatgaagatactggaacctagagatactccctaaatgggtttgcttttaggcagataagaacatgaatttaagaaggcagcatgttaacagatgtgtgagaattgttttctgtgtatccaaatccttgtttcacattgaatgtttttaaaatgaatttgaaattcagtatctattcaccatgacctaagagtatacagaggaaacagttagaaatgaccagttgagggtagggtgtttaattgagaagtcagcacacactggcagct

SEQ ID NO: 320167 - DNA, 544 bp, Homo sapiens
cttagagtaggtaccttgcatgcacatgcacactgtagctccttcccacaccccgacactcttcaatttttagggcccagattttgggccagcaggatagacattgccatgctttcactctttttgtgtcctttaagggttttttttttttttttttgcaacactgtaaaatccacatatctttttcctctaccccctctcattttacattttcaaattgttatagcagggtgagccctgaagatttcctttcacctcccttgcttttgtattcaaagatgaagatactggaacctagagatactccctaaatgggtttgcttttaggcagataagaacatgaatttaagaaggcagcatgttaacagatgtgtgagaattgttttctgtgtatccaaatccttgtttcacattgaatgtttttaaaatgaatttgaaattcagtatctattcaccatgacctaagagtatacagaggaaacagttagaaatgaccagttgagggtagggtgtttaattgagaagtcagcacacactggcagct

SEQ ID NO: 320168 - DNA, 5472 bp, Homo sapiens
cttcctgaaggtcgaggcacgctttcccaacatgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagtgaagccgccctgaaggaacgaattgagctcagaaaagtcaaagcctctgtggacatgtttgatcagcttttgcaagcaggaaccactgtgtctcttgaaacaacaaatagtctcttggatttattgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagcaccgagcttatgagcaggcattaaacttgtacactgagttactaaacaacagactccatgctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaatagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctagaagtgagttgctgaatgagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatggtctcaccatagctgctggaatcacacctgagaactgagatataccaatatttaacattgttacaaagaagaaaagatacagatttggtgaatttgttactgtgaggtacagtcagtacacagctgacttatgtagatttaagctgctaatatgctacttaaccatctattaatgcaccattaaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagccatgaatgtttcatgtctccctttttttttgtctatagctgttacctattttagtggttgaaatgagagctagtgatgacagaaggatgtggaatgtcttcttgacatcattgtgtattgctggtaatcaagttggtaacgactacttctagcagctcttaccactatgacttaagtggtcctggaaggcagtaagtggaggtttgcagcattcctgccttcatgagggcttctaccactgaccactttgcacgtacctggctcccagatttacttaggtaccccacgagtcgtccacataagcagcttcatctttaccttgccagagttgacaattatgggatactctagtctacttatacttgtgttcccatctgtctgccatcctctgaaggccaggacccagtcatacatccttagaaaccaaagtatggtttttgttttctcttggaatgtcaggtcttaaggcatttaattgagggacaaaaaaaaaaaaagccgatatagtagctagctacttaagcatccatgggtattgctccatatcaaagcagatttgcaggacagaaagagtaaattagccttcagtcttggtttacagcttccaaggagagccttggccacctgaaatgttaactcggtcccttcctgtctctagttcatcagcacctgcagatgcctgactcttgttagccttactattcaatacagtccttagattcacggtatgcctcttcctatccaggcacctattctgaatcaccatgttgctctgcagctagagttgataggagaaaatccatttgggtagatggcctatgaatttgtagtagactttcaaaatgagtgatttgttagcttggtacttttaagtttgtggtacagatcctccaaacccatactctgagcaattaactgccttgaacatagagaaaaattaaggcctcacaggatgagtctccattctctgtaaatgcttattttatcatagtctttagcctctactatgagtaaaatgttctcttcggccgggtgtggtgactcacacctgtaacctcagcactttgggaggcagaggtgggaggatcacttaggtccaggagttcgagactagcctgggcaacatagtgagacaccggatctacaaaaaaataaaaagccagactggtggtatgtatctgtgtcccagctaattgggagggtgagatgggaggattgtttgagcctaggagagggaggttgcagtgagccgtgattgcaccactgcactccagcctgggcaacagagcaagaccctgtcttggagaaaccagaattttggaagagcaaatggggctgagtgcagtggctcatgcctgtaatcccagcacttagggtgccaatgtggattacctgagcccaggagtttgagaccagcctgggtaacagtgagacccccctccctacaaaagattttaataattagttgggcgtagtggtgcatgcctgtaatcccagctactctggagacaggtggaggggattgcttgagcctgggaagctgaggctgcagtagccatgactgcaccactgcattccagcctggttgacagagtgacccttgtctccaagaaaaaaaaaaagcaaatgggattaaggactcatggaatgggaaggggaaggggagtcttactatatgtggaataaacttgctcagtgttgccacagagttacattaccaatgtgtagaagtcagaaactagacttctagtttggttcaacatttgagggttgttttatagccatcaaagtattcaagaggttggatggcactcaaaagattctacatgtctagaatcaaactcaaatctggcacgtaggtgcttcttagtaaatgcttaatgaatgccaccaactctgcaaagtattcattgattttgagaccttagtcatgttgctactaaaagtagggcatatgaccgcctaagaaacagaacttcgagaagtcctaacgtaaccacagtaaagcagactcccctttcagcaacctcaaagcaaaaaaaaaaaaaaaaaaaccagttagctgctatataaacactataccaagcactaggcttagaggaaaagatgtcagattgtactgtcactggctatgtacccatattctctaagacagggtagcatttgtctttcaaactgcagggtttgaaatcagtttttgtgggtgattgcaattttttaatgaaatgcattagaacatctaagcacgtcacctacagttttgtgatggtgcatttttgcattgcagtatagatctgtgcatagatatatgcattaagtgtagcaaatcgtgatgtaaattttttactgctggtcatggtcaaaaagtaagatacgctaggaaattgagtcactaggagcatggatgtataaggcaggttttatagaaccatttagattcaacattaatggtagagtggcattttaccaaaaaaatgggtgtatttgatttgggtgctgtaaggcaatttgctaggacatgggataatcagattacacaaaatctaggcagtgaacaagtcttcatcctggcccaggaaatagcctattaaaaaatgctgtccaggccaggcacagtggctcacacctgtaatcccaggacttcgggaggctgaggctggaggattgcttgagttcaagaccagcctgagcaacacagtgaaaacccatctcaaaaa

SEQ ID NO: 320169 - DNA, 6107 bp, Homo sapiens
cttcctgaaggtcgaggcacgctttcccaacatgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagtgaagccgccctgaaggaacgaattgagctcagaaaagtcaaagcctctgtggacatgtttgatcagcttttgcaagcaggaaccactgtgtctcttgaaacaacaaatagtctcttggatttattgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagcaccgagcttatgagcaggcattaaacttgtacactgagttactaaacaacagactccatgctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaataggtgaggatgcgcccttgagttctctgaggacagagactgtgccagccagaggtttcagggctacataagcaaagagctttaaattattcttgtgcttacataatatgttggaaattttctttccatgtttggcacatttacttacatgtacttattatagtgggagtgcctttatcatcttagtgttcattagtattttaggtactttgtttatggatctgttgaatctgaggagaagtgattgctttgagttagctagttttaaattcatgacattttcccaacataattaggtatttgaacctaagtgtgtgctagtgtattgtatatttttcattaattactttattgaaagttgctttgggaatcaattcacttcaatatattttactgttctcagtgaagaatgtgactaataagtatttggactttcaaaaagtgatacagtctttgtgatagttttttacctttacattaatgagttggaaaataactttgttcaaaggaatagaaatgcatattttgcttaaatattaacaatatgtttttaattcagtgtgtctcagtaaactatgttttggattgctgtgtttttacctcattgtttattttttctgtctacctggtaatttgagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctagaagtgagttgctgaatgagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatggtctcaccatagctgctggaatcacacctgagaactgagatataccaatatttaacattgttacaaagaagaaaagatacagatttggtgaatttgttactgtgaggtacagtcagtacacagctgacttatgtagatttaagctgctaatatgctacttaaccatctattaatgcaccattaaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagccatgaatgtttcatgtctccctttttttttgtctatagctgttacctattttagtggttgaaatgagagctagtgatgacagaaggatgtggaatgtcttcttgacatcattgtgtattgctggtaatcaagttggtaacgactacttctagcagctcttaccactatgacttaagtggtcctggaaggcagtaagtggaggtttgcagcattcctgccttcatgagggcttctaccactgaccactttgcacgtacctggctcccagatttacttaggtaccccacgagtcgtccacataagcagcttcatctttaccttgccagagttgacaattatgggatactctagtctacttatacttgtgttcccatctgtctgccatcctctgaaggccaggacccagtcatacatccttagaaaccaaagtatggtttttgttttctcttggaatgtcaggtcttaaggcatttaattgagggacaaaaaaaaaaaaagccgatatagtagctagctacttaagcatccatgggtattgctccatatcaaagcagatttgcaggacagaaagagtaaattagccttcagtcttggtttacagcttccaaggagagccttggccacctgaaatgttaactcggtcccttcctgtctctagttcatcagcacctgcagatgcctgactcttgttagccttactattcaatacagtccttagattcacggtatgcctcttcctatccaggcacctattctgaatcaccatgttgctctgcagctagagttgataggagaaaatccatttgggtagatggcctatgaatttgtagtagactttcaaaatgagtgatttgttagcttggtacttttaagtttgtggtacagatcctccaaacccatactctgagcaattaactgccttgaacatagagaaaaattaaggcctcacaggatgagtctccattctctgtaaatgcttattttatcatagtctttagcctctactatgagtaaaatgttctcttcggccgggtgtggtgactcacacctgtaacctcagcactttgggaggcagaggtgggaggatcacttaggtccaggagttcgagactagcctgggcaacatagtgagacaccggatctacaaaaaaataaaaagccagactggtggtatgtatctgtgtcccagctaattgggagggtgagatgggaggattgtttgagcctaggagagggaggttgcagtgagccgtgattgcaccactgcactccagcctgggcaacagagcaagaccctgtcttggagaaaccagaattttggaagagcaaatggggctgagtgcagtggctcatgcctgtaatcccagcacttagggtgccaatgtggattacctgagcccaggagtttgagaccagcctgggtaacagtgagacccccctccctacaaaagattttaataattagttgggcgtagtggtgcatgcctgtaatcccagctactctggagacaggtggaggggattgcttgagcctgggaagctgaggctgcagtagccatgactgcaccactgcattccagcctggttgacagagtgacccttgtctccaagaaaaaaaaaaagcaaatgggattaaggactcatggaatgggaaggggaaggggagtcttactatatgtggaataaacttgctcagtgttgccacagagttacattaccaatgtgtagaagtcagaaactagacttctagtttggttcaacatttgagggttgttttatagccatcaaagtattcaagaggttggatggcactcaaaagattctacatgtctagaatcaaactcaaatctggcacgtaggtgcttcttagtaaatgcttaatgaatgccaccaactctgcaaagtattcattgattttgagaccttagtcatgttgctactaaaagtagggcatatgaccgcctaagaaacagaacttcgagaagtcctaacgtaaccacagtaaagcagactcccctttcagcaacctcaaagcaaaaaaaaaaaaaaaaaaaccagttagctgctatataaacactataccaagcactaggcttagaggaaaagatgtcagattgtactgtcactggctatgtacccatattctctaagacagggtagcatttgtctttcaaactgcagggtttgaaatcagtttttgtgggtgattgcaattttttaatgaaatgcattagaacatctaagcacgtcacctacagttttgtgatggtgcatttttgcattgcagtatagatctgtgcatagatatatgcattaagtgtagcaaatcgtgatgtaaattttttactgctggtcatggtcaaaaagtaagatacgctaggaaattgagtcactaggagcatggatgtataaggcaggttttatagaaccatttagattcaacattaatggtagagtggcattttaccaaaaaaatgggtgtatttgatttgggtgctgtaaggcaatttgctaggacatgggataatcagattacacaaaatctaggcagtgaacaagtcttcatcctggcccaggaaatagcctattaaaaaatgctgtccaggccaggcacagtggctcacacctgtaatcccaggacttcgggaggctgaggctggaggattgcttgagttcaagaccagcctgagcaacacagtgaaaacccatctcaaaaa

SEQ ID NO: 320170 - DNA, 6085 bp, Homo sapiens
cttcctgaaggtcgaggcacgctttcccaacatgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagtgaagccgccctgaaggaacgaattgagctcagaaaagtcaaagcctctgtggacatgtttgatcagcttttgcaagcaggaaccactgtgtctcttgaaacaacaaatagtctcttggatttattgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagcaccgagcttatgagcaggcattaaacttgtacactgagttactaaacaacagactccatgctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaataggtgaggatgcgcccttgagttctctgaggacagagactgtgccagccagaggtttcagggctacataagcaaagagctttaaattattcttgtgcttacataatatgttggaaattttctttccatgtttggcacatttacttacatgtacttattatagtgggagtgcctttatcatcttagtgttcattagtattttaggtactttgtttatggatctgttgaatctgaggagaagtgattgctttgagttagctagttttaaattcatgacattttcccaacataattaggtatttgaacctaagtgtgtgctagtgtattgtatatttttcattaattactttattgaaagttgctttgggaatcaattcacttcaatatattttactgttctcagtgaagaatgtgactaataagtatttggactttcaaaaagtgatacagtctttgtgatagttttttacctttacattaatgagttggaaaataactttgttcaaaggaatagaaatgcatattttgcttaaatattaacaatatgtttttaattcagtgtgtctcagtaaactatgttttggattgctgtgtttttacctcattgtttattttttctgtctacctggtaatttgagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggcctactttccccactcccaaacaatgatacatcttctccaagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctagaagtgagttgctgaatgagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatggtctcaccatagctgctggaatcacacctgagaactgagatataccaatatttaacattgttacaaagaagaaaagatacagatttggtgaatttgttactgtgaggtacagtcagtacacagctgacttatgtagatttaagctgctaatatgctacttaaccatctattaatgcaccattaaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagccatgaatgtttcatgtctccctttttttttgtctatagctgttacctattttagtggttgaaatgagagctagtgatgacagaaggatgtggaatgtcttcttgacatcattgtgtattgctggtaatcaagttggtaacgactacttctagcagctcttaccactatgacttaagtggtcctggaaggcagtaagtggaggtttgcagcattcctgccttcatgagggcttctaccactgaccactttgcacgtacctggctcccagatttacttaggtaccccacgagtcgtccacataagcagcttcatctttaccttgccagagttgacaattatgggatactctagtctacttatacttgtgttcccatctgtctgccatcctctgaaggccaggacccagtcatacatccttagaaaccaaagtatggtttttgttttctcttggaatgtcaggtcttaaggcatttaattgagggacaaaaaaaaaaaaagccgatatagtagctagctacttaagcatccatgggtattgctccatatcaaagcagatttgcaggacagaaagagtaaattagccttcagtcttggtttacagcttccaaggagagccttggccacctgaaatgttaactcggtcccttcctgtctctagttcatcagcacctgcagatgcctgactcttgttagccttactattcaatacagtccttagattcacggtatgcctcttcctatccaggcacctattctgaatcaccatgttgctctgcagctagagttgataggagaaaatccatttgggtagatggcctatgaatttgtagtagactttcaaaatgagtgatttgttagcttggtacttttaagtttgtggtacagatcctccaaacccatactctgagcaattaactgccttgaacatagagaaaaattaaggcctcacaggatgagtctccattctctgtaaatgcttattttatcatagtctttagcctctactatgagtaaaatgttctcttcggccgggtgtggtgactcacacctgtaacctcagcactttgggaggcagaggtgggaggatcacttaggtccaggagttcgagactagcctgggcaacatagtgagacaccggatctacaaaaaaataaaaagccagactggtggtatgtatctgtgtcccagctaattgggagggtgagatgggaggattgtttgagcctaggagagggaggttgcagtgagccgtgattgcaccactgcactccagcctgggcaacagagcaagaccctgtcttggagaaaccagaattttggaagagcaaatggggctgagtgcagtggctcatgcctgtaatcccagcacttagggtgccaatgtggattacctgagcccaggagtttgagaccagcctgggtaacagtgagacccccctccctacaaaagattttaataattagttgggcgtagtggtgcatgcctgtaatcccagctactctggagacaggtggaggggattgcttgagcctgggaagctgaggctgcagtagccatgactgcaccactgcattccagcctggttgacagagtgacccttgtctccaagaaaaaaaaaaagcaaatgggattaaggactcatggaatgggaaggggaaggggagtcttactatatgtggaataaacttgctcagtgttgccacagagttacattaccaatgtgtagaagtcagaaactagacttctagtttggttcaacatttgagggttgttttatagccatcaaagtattcaagaggttggatggcactcaaaagattctacatgtctagaatcaaactcaaatctggcacgtaggtgcttcttagtaaatgcttaatgaatgccaccaactctgcaaagtattcattgattttgagaccttagtcatgttgctactaaaagtagggcatatgaccgcctaagaaacagaacttcgagaagtcctaacgtaaccacagtaaagcagactcccctttcagcaacctcaaagcaaaaaaaaaaaaaaaaaaaccagttagctgctatataaacactataccaagcactaggcttagaggaaaagatgtcagattgtactgtcactggctatgtacccatattctctaagacagggtagcatttgtctttcaaactgcagggtttgaaatcagtttttgtgggtgattgcaattttttaatgaaatgcattagaacatctaagcacgtcacctacagttttgtgatggtgcatttttgcattgcagtatagatctgtgcatagatatatgcattaagtgtagcaaatcgtgatgtaaattttttactgctggtcatggtcaaaaagtaagatacgctaggaaattgagtcactaggagcatggatgtataaggcaggttttatagaaccatttagattcaacattaatggtagagtggcattttaccaaaaaaatgggtgtatttgatttgggtgctgtaaggcaatttgctaggacatgggataatcagattacacaaaatctaggcagtgaacaagtcttcatcctggcccaggaaatagcctattaaaaaatgctgtccaggccaggcacagtggctcacacctgtaatcccaggacttcgggaggctgaggctggaggattgcttgagttcaagaccagcctgagcaacacagtgaaaacccatctcaaaaa

SEQ ID NO: 320171 - DNA, 2694 bp, Homo sapiens
cttcctgaaggtcgaggcacgctttcccaacatgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagtgaagccgccctgaaggaacgaattgagctcagaaaagtcaaagcctctgtggacatgtttgatcagcttttgcaagcaggaaccactgtgtctcttgaaacaacaaatagtctcttggatttattgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaatagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctagaagtgagttgctgaatgagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatggtctcaccatagctgctggaatcacacctgagaactgagatataccaatatttaacattgttacaaagaagaaaagatacagatttggtgaatttgttactgtgaggtacagtcagtacacagctgacttatgtagatttaagctgctaatatgctacttaaccatctattaatgcaccattaaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagc

SEQ ID NO: 320172 - DNA, 2179 bp, Homo sapiens
cttcctgaaggtcgaggcacgctttcccaacatgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagtgaagccgccctgaaggaacgaattgagctcagaaaagtcaaagcctctgtggacatgtttgatcagcttttgcaagcaggaaccactgtgtctcttgaaacaacaaatagtctcttggatttattgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagcaccgagcttatgagcaggcattaaacttgtacactgagttactaaacaacagactccatgctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaatagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctaggtaagttgaaatcagccagctctctttgggtacagcctggaagtagccacatttggaatttcttcaccagccttagccaccacatttgggcactcttctgttaggcaagcataccgtcaactccctactatccagggcatcctgaggcaagcagttttttatctgtgttcacggatcatcatacattggggctacattgaatagatcatcatgaagtcatactgaatgaatgttgataatccatttggccctttagactttctaacctcactggaaacaagtaaaaataaatgttagacttcatct

SEQ ID NO: 320173 - DNA, 2664 bp, Homo sapiens
cttcctgaaggtcgaggcacgctttcccaacatgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagtgaagccgccctgaaggaacgaattgagctcagaaaagtcaaagcctctgtggacatgtttgatcagcttttgcaagcaggaaccactgtgtctcttgaaacaacaaatagtctcttggatttattgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagcaccgagcttatgagcaggcattaaacttgtacactgagttactaaacaacagactccatgctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaataggtgaggatgcgcccttgagttctctgaggacagagactgtgccagccagaggtttcagggctacataagcaaagagctttaaattattcttgtgcttacataatatgttggaaattttctttccatgtttggcacatttacttacatgtacttattatagtgggagtgcctttatcatcttagtgttcattagtattttaggtactttgtttatggatctgttgaatctgaggagaagtgattgctttgagttagctagttttaaattcatgacattttcccaacataattaggtatttgaacctaagtgtgtgctagtgtattgtatatttttcattaattactttattgaaagttgctttgggaatcaattcacttcaatatattttactgttctcagtgaagaatgtgactaataagtatttggactttcaaaaagtgatacagtctttgtgatagttttttacctttacattaatgagttggaaaataactttgttcaaaggaatagaaatgcatattttgcttaaatattaacaatatgtttttaattcagtgtgtctcagtaaactatgttttggattgctgtgtttttacctcattgtttattttttctgtctacctggtaatttgagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattagtaagtgtgttggaaacatatccttttgcatgagttaccagattctgcaagtgggaggctgttgatgtcccttcatacctcacctctggtttcaggcaacatgccaatgatctaataggacatgttaattgagcacttaggaattaaagcagtggtaaaactgccagatttgaaagactagtttgtgtcctttaagggttttttttttttttttttgcaacactgtaaaatccacatatctttttcctctaccccctctcattttacattttcaaattgttatagcagggtgagccctgaagatttcctttcacctcccttgcttttgtattcaaagatgaagatactggaacctagagatactccctaaatgggtttgcttttaggcagataagaacatgaatttaagaaggcagcatgttaacagatgtgtgagaattgttttctgtgtatccaaatccttgtttcacattgaatgtttttaaaatgaatttgaaattcagtatctattcaccatgacctaagagtatacagaggaaacagttagaaatgaccagttgagggtagggtgtttaattgagaagtcagcacacactggcagct

SEQ ID NO: 320174 - DNA, 3254 bp, Homo sapiens
tcataggttcgcaggcacacagtgcacagcaggttctggataattcggccgatttggcaaaacgctttcgcaaactgggcgcgccggtggtgatggttcgcgtcggttggtctgacacctttgcagaagcgctgaagcaagaagtggatcgcccgtcccctgcgaacctatctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagccatgaatgtttcatgtctccctttttttttgtctatagctgttacctattttagtggttgaaatgagagctagtgatgacagaaggatgtggaatgtcttcttgacatcattgtgtattgctggtaatcaagttggtaacgactacttctagcagctcttaccactatgacttaagtggtcctggaaggcagtaagtggaggtttgcagcattcctgccttcatgagggcttctaccactgaccactttgcacgtacctggctcccagatttacttaggtaccccacgagtcgtccacataagcagcttcatctttaccttgccagagttgacaattatgggatactctagtctacttatacttgtgttcccatctgtctgccatcctctgaaggccaggacccagtcatacatccttagaaaccaaagtatggtttttgttttctcttggaatgtcaggtcttaaggcatttaattgagggacaaaaaaaaaaaaagccgatatagtagctagctacttaagcatccatgggtattgctccatatcaaagcagatttgcaggacagaaagagtaaattagccttcagtcttggtttacagcttccaaggagagccttggccacctgaaatgttaactcggtcccttcctgtctctagttcatcagcacctgcagatgcctgactcttgttagccttactattcaatacagtccttagattcacggtatgcctcttcctatccaggcacctattctgaatcaccatgttgctctgcagctagagttgataggagaaaatccatttgggtagatggcctatgaatttgtagtagactttcaaaatgagtgatttgttagcttggtacttttaagtttgtggtacagatcctccaaacccatactctgagcaattaactgccttgaacatagagaaaaattaaggcctcacaggatgagtctccattctctgtaaatgcttattttatcatagtctttagcctctactatgagtaaaatgttctcttcggccgggtgtggtgactcacacctgtaacctcagcactttgggaggcagaggtgggaggatcacttaggtccaggagttcgagactagcctgggcaacatagtgagacaccggatctacaaaaaaataaaaagccagactggtggtatgtatctgtgtcccagctaattgggagggtgagatgggaggattgtttgagcctaggagagggaggttgcagtgagccgtgattgcaccactgcactccagcctgggcaacagagcaagaccctgtcttggagaaaccagaattttggaagagcaaatggggctgagtgcagtggctcatgcctgtaatcccagcacttagggtgccaatgtggattacctgagcccaggagtttgagaccagcctgggtaacagtgagacccccctccctacaaaagattttaataattagttgggcgtagtggtgcatgcctgtaatcccagctactctggagacaggtggaggggattgcttgagcctgggaagctgaggctgcagtagccatgactgcaccactgcattccagcctggttgacagagtgacccttgtctccaagaaaaaaaaaaagcaaatgggattaaggactcatggaatgggaaggggaaggggagtcttactatatgtggaataaacttgctcagtgttgccacagagttacattaccaatgtgtagaagtcagaaactagacttctagtttggttcaacatttgagggttgttttatagccatcaaagtattcaagaggttggatggcactcaaaagattctacatgtctagaatcaaactcaaatctggcacgtaggtgcttcttagtaaatgcttaatgaatgccaccaactctgcaaagtattcattgattttgagaccttagtcatgttgctactaaaagtagggcatatgaccgcctaagaaacagaacttcgagaagtcctaacgtaaccacagtaaagcagactcccctttcagcaacctcaaagcaaaaaaaaaaaaaaaaaaaccagttagctgctatataaacactataccaagcactaggcttagaggaaaagatgtcagattgtactgtcactggctatgtacccatattctctaagacagggtagcatttgtctttcaaactgcagggtttgaaatcagtttttgtgggtgattgcaattttttaatgaaatgcattagaacatctaagcacgtcacctacagttttgtgatggtgcatttttgcattgcagtatagatctgtgcatagatatatgcattaagtgtagcaaatcgtgatgtaaattttttactgctggtcatggtcaaaaagtaagatacgctaggaaattgagtcactaggagcatggatgtataaggcaggttttatagaaccatttagattcaacattaatggtagagtggcattttaccaaaaaaatgggtgtatttgatttgggtgctgtaaggcaatttgctaggacatgggataatcagattacacaaaatctaggcagtgaacaagtcttcatcctggcccaggaaatagcctattaaaaaatgctgtccaggccaggcacagtggctcacacctgtaatcccaggacttcgggaggctgaggctggaggattgcttgagttcaagaccagcctgagcaacacagtgaaaacccatctcaaaaa

SEQ ID NO: 320175 - DNA, 606 bp, Homo sapiens
cttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctgggtgagtacagtaccacaagtatacactttagaagcttttgtatttgaatctaaaacattggcccacgctggtagaggttctttcatttggccacataacacgtatttgattcgggaacttgcaaataccaactaaaaagcaaacttttggaagaagacagtatgcatgatgtagttgagataaggcatagttctctcaaaccatacgctgagaattatctttctactttctgtgtctatggacaagtaagtcacttaacctcattattccacttaaatgaactaaagatcaaagaaatatatgatcaaagaaacgtagttttgaaaatggtttggtcatttgggttattgaagtatttttggatgcttctcccatcccactctccagcttaaaatgtgggctgtgtacttagacttctggaagctggcatttacgcacattaactaaacttggcct

SEQ ID NO: 320176 - DNA, 232 bp, Homo sapiens
ggtgtatatagcttagtaatatttgccatggtctttctgagaaagccaaaattgtggtacattcctgcctctcttaagtttttatgttcttagctttatcttgcatgttaccagttttgttggcaggatttttgttaatgttactgacttgaaaatatattttatccattgtaaccaaagctcttgtgaactttgattttcagataagttttttcagtcagccatgagcata

SEQ ID NO: 320177 - DNA, 331 bp, Homo sapiens
ctttcatccatctgcccattcaaaatgttcatagctttctatcccttctatttcctttcaaaaagtcagaatgtagtaatttaatgactatttcatttgtcatgcaagtcaggaaagcctatagatttgactgttagaagctttttgtttctaatatagtttaatgcaactgcagggtccctttttctgatttcaaaactgacaggctataggtgagtgtcagagacaccgagaaccccagcacccagttgaattgcagtgtaatcctccattttcttttcttaacagggaagccctaagtaatctaactgcattgaccagtgacagtgat

SEQ ID NO: 320178 - DNA, 347 bp, Homo sapiens
acaacgtcttaaccacgtggagctggtggctgctcccatgtagtgcacatgccgtgatgaacacgtcactggagcaaggcccaggcattggcttttacatttgttccactgtgaatcctggtgggtttctggaatcctgggataagcctagaataaataacagcaacttatttttacctaccaaaaaataggttgacagtgaacaaaagtgtgttggttttacataacaatgatcactccttgttcctttcttgtttcaagatagtaaagaatatggtcatactttccgcagtgacctgagagaagagatcctgatgctcatggcaagggacaagcacccaccagag

SEQ ID NO: 320179 - DNA, 401 bp, Homo sapiens
tccccattttcaaaatgataataaccataataccctgtaagaattgagataatgtatataaagtacttggcacattgcctagaacataataaaccgtcagtaaatggtggtagctctcattggtatttcttattgcctgggttcacatttactctcttgtgtctagagcaaaaaacaacgctgagagaatcttttctctaatgccagagaaaaatgaacattcctattgcacaatgatccgaggaatggtgaagggtacatttgttttatttatttttgtctttcatttccaccgatcagggtgtttcagcctcagaactactaacattttgggtcaggtaatttgttgtggggtctgtcctgtgcattgtaggatgttagtagctccctggcttctaccc

SEQ ID NO: 320180 - DNA, 462 bp, Homo sapiens
ttttttttgtctatagctgttacctattttagtggttgaaatgagagctagtgatgacagaaggatgtggaatgtcttcttgacatcattgtgtattgctggtaatcaagttggtaacgactacttctagcagctcttaccactatgacttaagtggtcctggaaggcagtaagtggaggtttgcagcattcctgccttcatgagggcttctaccactgaccactttgcacgtacctggctcccagatttacttaggtaccccacgagtcgtccacataagcagcttcatctttaccttgccagagttgacaattatgggatactctagtctacttatacttgtgttcccatctgtctgccatcctctgaaggccaggacccagtcatacatccttagaaaccaaagtatggtttttgttttctcttggaatgtcaggtcttaaggcatttaattgagggac

SEQ ID NO: 320181 - DNA, 4801 bp, Homo sapiens
cttcctgaaggtcgaggcacgctttcccaacatgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagtgaagccgccctgaaggaacgaattgagctcagaaaagtcaaagcctctgtggacatgtttgatcagcttttgcaagcaggaaccactgtgtctcttgaaacaacaaatagtctcttggatttattgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagcaccgagcttatgagcaggcattaaacttgtacactgagttactaaacaacagactccatgctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaatagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctagaagtgagttgctgaatgagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatggtctcaccatagctgctggaatcacacctgagaactgagatataccaatatttaacattgttacaaagaagaaaagatacagatttggtgaatttgttactgtgaggtacagtcagtacacagctgacttatgtagatttaagctgctaatatgctacttaaccatctattaatgcaccattaaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagccatgaatgtttcatgtctccctttttttttgtctatagctgttacctattttagtggttgaaatgagagctagtgatgacagaaggatgtggaatgtcttcttgacatcattgtgtattgctggtaatcaagttggtaacgactacttctagcagctcttaccactatgacttaagtggtcctggaaggcagtaagtggaggtttgcagcattcctgccttcatgagggcttctaccactgaccactttgcacgtacctggctcccagatttacttaggtaccccacgagtcgtccacataagcagcttcatctttaccttgccagagttgacaattatgggatactctagtctacttatacttgtgttcccatctgtctgccatcctctgaaggccaggacccagtcatacatccttagaaaccaaagtatggtttttgttttctcttggaatgtcaggtcttaaggcatttaattgagggacaaaaaaaaaaaaagccgatatagtagctagctacttaagcatccatgggtattgctccatatcaaagcagatttgcaggacagaaagagtaaattagccttcagtcttggtttacagcttccaaggagagccttggccacctgaaatgttaactcggtcccttcctgtctctagttcatcagcactgcagtggctcatgcctgtaatcccagcacttagggtgccaatgtggattacctgagcccaggagtttgagaccagcctgggtaacagtgagacccccctccctacaaaagattttaataattagttgggcgtagtggtgcatgcctgtaatcccagctactctggagacaggtggaggggattgcttgagcctgggaagctgaggctgcagtagccatgactgcaccactgcattccagcctggttgacagagtgacccttgtctccaagaaaaaaaaaaagcaaatgggattaaggactcatggaatgggaaggggaaggggagtcttactatatgtggaataaacttgctcagtgttgccacagagttacattaccaatgtgtagaagtcagaaactagacttctagtttggttcaacatttgagggttgttttatagccatcaaagtattcaagaggttggatggcactcaaaagattctacatgtctagaatcaaactcaaatctggcacgtaggtgcttcttagtaaatgcttaatgaatgccaccaactctgcaaagtattcattgattttgagaccttagtcatgttgctactaaaagtagggcatatgaccgcctaagaaacagaacttcgagaagtcctaacgtaaccacagtaaagcagactcccctttcagcaacctcaaagcaaaaaaaaaaaaaaaaaaaccagttagctgctatataaacactataccaagcactaggcttagaggaaaagatgtcagattgtactgtcactggctatgtacccatattctctaagacagggtagcatttgtctttcaaactgcagggtttgaaatcagtttttgtgggtgattgcaattttttaatgaaatgcattagaacatctaagcacgtcacctacagttttgtgatggtgcatttttgcattgcagtatagatctgtgcatagatatatgcattaagtgtagcaaatcgtgatgtaaattttttactgctggtcatggtcaaaaagtaagatacgctaggaaattgagtcactaggagcatggatgtataaggcaggttttatagaaccatttagattcaacattaatggtagagtggcattttaccaaaaaaatgggtgtatttgatttgggtgctgtaaggcaatttgctaggacatgggataatcagattacacaaaatctaggcagtgaacaagtcttcatcctggcccaggaaatagcctattaaaaaatgctgtccaggccaggcacagtggctcacacctgtaatcccaggacttcgggaggctgaggctggaggattgcttgagttcaagaccagcctgagcaacacagtgaaaacccatctcaaaaa

SEQ ID NO: 320182 - DNA, 5421 bp, Homo sapiens
cttcctgaaggtcgaggcacgctttcccaacatgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagtgaagccgccctgaaggaacgaattgagctcagaaaagtcaaagcctctgtggacatgtttgatcagcttttgcaagcaggaaccactgtgtctcttgaaacaacaaatagtctcttggatttattgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagcaccgagcttatgagcaggcattaaacttgtacactgagttactaaacaacagactccatgctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaataggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctagaagtgagttgctgaatgagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatggtctcaccatagctgctggaatcacacctgagaactgagatataccaatatttaacattgttacaaagaagaaaagatacagatttggtgaatttgttactgtgaggtacagtcagtacacagctgacttatgtagatttaagctgctaatatgctacttaaccatctattaatgcaccattaaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagccatgaatgtttcatgtctccctttttttttgtctatagctgttacctattttagtggttgaaatgagagctagtgatgacagaaggatgtggaatgtcttcttgacatcattgtgtattgctggtaatcaagttggtaacgactacttctagcagctcttaccactatgacttaagtggtcctggaaggcagtaagtggaggtttgcagcattcctgccttcatgagggcttctaccactgaccactttgcacgtacctggctcccagatttacttaggtaccccacgagtcgtccacataagcagcttcatctttaccttgccagagttgacaattatgggatactctagtctacttatacttgtgttcccatctgtctgccatcctctgaaggccaggacccagtcatacatccttagaaaccaaagtatggtttttgttttctcttggaatgtcaggtcttaaggcatttaattgagggacaaaaaaaaaaaaagccgatatagtagctagctacttaagcatccatgggtattgctccatatcaaagcagatttgcaggacagaaagagtaaattagccttcagtcttggtttacagcttccaaggagagccttggccacctgaaatgttaactcggtcccttcctgtctctagttcatcagcacctgcagatgcctgactcttgttagccttactattcaatacagtccttagattcacggtatgcctcttcctatccaggcacctattctgaatcaccatgttgctctgcagctagagttgataggagaaaatccatttgggtagatggcctatgaatttgtagtagactttcaaaatgagtgatttgttagcttggtacttttaagtttgtggtacagatcctccaaacccatactctgagcaattaactgccttgaacatagagaaaaattaaggcctcacaggatgagtctccattctctgtaaatgcttattttatcatagtctttagcctctactatgagtaaaatgttctcttcggccgggtgtggtgactcacacctgtaacctcagcactttgggaggcagaggtgggaggatcacttaggtccaggagttcgagactagcctgggcaacatagtgagacaccggatctacaaaaaaataaaaagccagactggtggtatgtatctgtgtcccagctaattgggagggtgagatgggaggattgtttgagcctaggagagggaggttgcagtgagccgtgattgcaccactgcactccagcctgggcaacagagcaagaccctgtcttggagaaaccagaattttggaagagcaaatggggctgagtgcagtggctcatgcctgtaatcccagcacttagggtgccaatgtggattacctgagcccaggagtttgagaccagcctgggtaacagtgagacccccctccctacaaaagattttaataattagttgggcgtagtggtgcatgcctgtaatcccagctactctggagacaggtggaggggattgcttgagcctgggaagctgaggctgcagtagccatgactgcaccactgcattccagcctggttgacagagtgacccttgtctccaagaaaaaaaaaaagcaaatgggattaaggactcatggaatgggaaggggaaggggagtcttactatatgtggaataaacttgctcagtgttgccacagagttacattaccaatgtgtagaagtcagaaactagacttctagtttggttcaacatttgagggttgttttatagccatcaaagtattcaagaggttggatggcactcaaaagattctacatgtctagaatcaaactcaaatctggcacgtaggtgcttcttagtaaatgcttaatgaatgccaccaactctgcaaagtattcattgattttgagaccttagtcatgttgctactaaaagtagggcatatgaccgcctaagaaacagaacttcgagaagtcctaacgtaaccacagtaaagcagactcccctttcagcaacctcaaagcaaaaaaaaaaaaaaaaaaaccagttagctgctatataaacactataccaagcactaggcttagaggaaaagatgtcagattgtactgtcactggctatgtacccatattctctaagacagggtagcatttgtctttcaaactgcagggtttgaaatcagtttttgtgggtgattgcaattttttaatgaaatgcattagaacatctaagcacgtcacctacagttttgtgatggtgcatttttgcattgcagtatagatctgtgcatagatatatgcattaagtgtagcaaatcgtgatgtaaattttttactgctggtcatggtcaaaaagtaagatacgctaggaaattgagtcactaggagcatggatgtataaggcaggttttatagaaccatttagattcaacattaatggtagagtggcattttaccaaaaaaatgggtgtatttgatttgggtgctgtaaggcaatttgctaggacatgggataatcagattacacaaaatctaggcagtgaacaagtcttcatcctggcccaggaaatagcctattaaaaaatgctgtccaggccaggcacagtggctcacacctgtaatcccaggacttcgggaggctgaggctggaggattgcttgagttcaagaccagcctgagcaacacagtgaaaacccatctcaaaaa

SEQ ID NO: 320183 - DNA, 5411 bp, Homo sapiens
cttcctgaaggtcgaggcacgctttcccaacatgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagtgaagccgccctgaaggaacgaattgagctcagaaaagtcaaagcctctgtggacatgtttgatcagcttttgcaagcaggaaccactgtgtctcttgaaacaacaaatagtctcttggatttattgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaatagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctagaagtgagttgctgaatgagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatggtctcaccatagctgctggaatcacacctgagaactgagatataccaatatttaacattgttacaaagaagaaaagatacagatttggtgaatttgttactgtgaggtacagtcagtacacagctgacttatgtagatttaagctgctaatatgctacttaaccatctattaatgcaccattaaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagccatgaatgtttcatgtctccctttttttttgtctatagctgttacctattttagtggttgaaatgagagctagtgatgacagaaggatgtggaatgtcttcttgacatcattgtgtattgctggtaatcaagttggtaacgactacttctagcagctcttaccactatgacttaagtggtcctggaaggcagtaagtggaggtttgcagcattcctgccttcatgagggcttctaccactgaccactttgcacgtacctggctcccagatttacttaggtaccccacgagtcgtccacataagcagcttcatctttaccttgccagagttgacaattatgggatactctagtctacttatacttgtgttcccatctgtctgccatcctctgaaggccaggacccagtcatacatccttagaaaccaaagtatggtttttgttttctcttggaatgtcaggtcttaaggcatttaattgagggacaaaaaaaaaaaaagccgatatagtagctagctacttaagcatccatgggtattgctccatatcaaagcagatttgcaggacagaaagagtaaattagccttcagtcttggtttacagcttccaaggagagccttggccacctgaaatgttaactcggtcccttcctgtctctagttcatcagcacctgcagatgcctgactcttgttagccttactattcaatacagtccttagattcacggtatgcctcttcctatccaggcacctattctgaatcaccatgttgctctgcagctagagttgataggagaaaatccatttgggtagatggcctatgaatttgtagtagactttcaaaatgagtgatttgttagcttggtacttttaagtttgtggtacagatcctccaaacccatactctgagcaattaactgccttgaacatagagaaaaattaaggcctcacaggatgagtctccattctctgtaaatgcttattttatcatagtctttagcctctactatgagtaaaatgttctcttcggccgggtgtggtgactcacacctgtaacctcagcactttgggaggcagaggtgggaggatcacttaggtccaggagttcgagactagcctgggcaacatagtgagacaccggatctacaaaaaaataaaaagccagactggtggtatgtatctgtgtcccagctaattgggagggtgagatgggaggattgtttgagcctaggagagggaggttgcagtgagccgtgattgcaccactgcactccagcctgggcaacagagcaagaccctgtcttggagaaaccagaattttggaagagcaaatggggctgagtgcagtggctcatgcctgtaatcccagcacttagggtgccaatgtggattacctgagcccaggagtttgagaccagcctgggtaacagtgagacccccctccctacaaaagattttaataattagttgggcgtagtggtgcatgcctgtaatcccagctactctggagacaggtggaggggattgcttgagcctgggaagctgaggctgcagtagccatgactgcaccactgcattccagcctggttgacagagtgacccttgtctccaagaaaaaaaaaaagcaaatgggattaaggactcatggaatgggaaggggaaggggagtcttactatatgtggaataaacttgctcagtgttgccacagagttacattaccaatgtgtagaagtcagaaactagacttctagtttggttcaacatttgagggttgttttatagccatcaaagtattcaagaggttggatggcactcaaaagattctacatgtctagaatcaaactcaaatctggcacgtaggtgcttcttagtaaatgcttaatgaatgccaccaactctgcaaagtattcattgattttgagaccttagtcatgttgctactaaaagtagggcatatgaccgcctaagaaacagaacttcgagaagtcctaacgtaaccacagtaaagcagactcccctttcagcaacctcaaagcaaaaaaaaaaaaaaaaaaaccagttagctgctatataaacactataccaagcactaggcttagaggaaaagatgtcagattgtactgtcactggctatgtacccatattctctaagacagggtagcatttgtctttcaaactgcagggtttgaaatcagtttttgtgggtgattgcaattttttaatgaaatgcattagaacatctaagcacgtcacctacagttttgtgatggtgcatttttgcattgcagtatagatctgtgcatagatatatgcattaagtgtagcaaatcgtgatgtaaattttttactgctggtcatggtcaaaaagtaagatacgctaggaaattgagtcactaggagcatggatgtataaggcaggttttatagaaccatttagattcaacattaatggtagagtggcattttaccaaaaaaatgggtgtatttgatttgggtgctgtaaggcaatttgctaggacatgggataatcagattacacaaaatctaggcagtgaacaagtcttcatcctggcccaggaaatagcctattaaaaaatgctgtccaggccaggcacagtggctcacacctgtaatcccaggacttcgggaggctgaggctggaggattgcttgagttcaagaccagcctgagcaacacagtgaaaacccatctcaaaaa

SEQ ID NO: 320184 - DNA, 5335 bp, Homo sapiens
tgttgctcaggtgagagagagcacaaggagggaagtgccacacacttttaaaccatcagatctcttggaactcactcactatcatgagaatagcaggtggatcacttgaggtcaggggtttgagaccagcctggccaacatggtgaaacctcatctctactaaaaatacaacaattagctaggcgtggtggcacgtgcctgtaattccagctactcgagaggtggaggcaggagaatcacttaaacccaggaggtggaggttatggaatgagagaagagttaaaagtacatatgctagaatatgaccagaaggatccaaaagaaaccgttttgcctctgggaagtagtatctgaagattgaagaaaggtgaggaaactttactagggactttgtcatacagttgcttcttgtttttaatagcacagatatttatatacttgtttataaacttttcattttcaattgtaattctgccacttaacctgcgaagccctgacaacacattaagatcgttaagtcttgattttccccattttcaaaatgataataaccataataccctgtaagaattgagataatgtatataaagtacttggcacattgcctagaacataataaaccgtcagtaaatggtggtagctctcattggtatttcttattgcctgggttcacatttactctcttgtgtctagagcaaaaaacaacgctgagagaatcttttctctaatgccagagaaaaatgaacattcctattgcacaatgatccgaggaatggtgaagctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaatagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctagaagtgagttgctgaatgagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatggtctcaccatagctgctggaatcacacctgagaactgagatataccaatatttaacattgttacaaagaagaaaagatacagatttggtgaatttgttactgtgaggtacagtcagtacacagctgacttatgtagatttaagctgctaatatgctacttaaccatctattaatgcaccattaaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagccatgaatgtttcatgtctccctttttttttgtctatagctgttacctattttagtggttgaaatgagagctagtgatgacagaaggatgtggaatgtcttcttgacatcattgtgtattgctggtaatcaagttggtaacgactacttctagcagctcttaccactatgacttaagtggtcctggaaggcagtaagtggaggtttgcagcattcctgccttcatgagggcttctaccactgaccactttgcacgtacctggctcccagatttacttaggtaccccacgagtcgtccacataagcagcttcatctttaccttgccagagttgacaattatgggatactctagtctacttatacttgtgttcccatctgtctgccatcctctgaaggccaggacccagtcatacatccttagaaaccaaagtatggtttttgttttctcttggaatgtcaggtcttaaggcatttaattgagggacaaaaaaaaaaaaagccgatatagtagctagctacttaagcatccatgggtattgctccatatcaaagcagatttgcaggacagaaagagtaaattagccttcagtcttggtttacagcttccaaggagagccttggccacctgaaatgttaactcggtcccttcctgtctctagttcatcagcacctgcagatgcctgactcttgttagccttactattcaatacagtccttagattcacggtatgcctcttcctatccaggcacctattctgaatcaccatgttgctctgcagctagagttgataggagaaaatccatttgggtagatggcctatgaatttgtagtagactttcaaaatgagtgatttgttagcttggtacttttaagtttgtggtacagatcctccaaacccatactctgagcaattaactgccttgaacatagagaaaaattaaggcctcacaggatgagtctccattctctgtaaatgcttattttatcatagtctttagcctctactatgagtaaaatgttctcttcggccgggtgtggtgactcacacctgtaacctcagcactttgggaggcagaggtgggaggatcacttaggtccaggagttcgagactagcctgggcaacatagtgagacaccggatctacaaaaaaataaaaagccagactggtggtatgtatctgtgtcccagctaattgggagggtgagatgggaggattgtttgagcctaggagagggaggttgcagtgagccgtgattgcaccactgcactccagcctgggcaacagagcaagaccctgtcttggagaaaccagaattttggaagagcaaatggggctgagtgcagtggctcatgcctgtaatcccagcacttagggtgccaatgtggattacctgagcccaggagtttgagaccagcctgggtaacagtgagacccccctccctacaaaagattttaataattagttgggcgtagtggtgcatgcctgtaatcccagctactctggagacaggtggaggggattgcttgagcctgggaagctgaggctgcagtagccatgactgcaccactgcattccagcctggttgacagagtgacccttgtctccaagaaaaaaaaaaagcaaatgggattaaggactcatggaatgggaaggggaaggggagtcttactatatgtggaataaacttgctcagtgttgccacagagttacattaccaatgtgtagaagtcagaaactagacttctagtttggttcaacatttgagggttgttttatagccatcaaagtattcaagaggttggatggcactcaaaagattctacatgtctagaatcaaactcaaatctggcacgtaggtgcttcttagtaaatgcttaatgaatgccaccaactctgcaaagtattcattgattttgagaccttagtcatgttgctactaaaagtagggcatatgaccgcctaagaaacagaacttcgagaagtcctaacgtaaccacagtaaagcagactcccctttcagcaacctcaaagcaaaaaaaaaaaaaaaaaaaccagttagctgctatataaacactataccaagcactaggcttagaggaaaagatgtcagattgtactgtcactggctatgtacccatattctctaagacagggtagcatttgtctttcaaactgcagggtttgaaatcagtttttgtgggtgattgcaattttttaatgaaatgcattagaacatctaagcacgtcacctacagttttgtgatggtgcatttttgcattgcagtatagatctgtgcatagatatatgcattaagtgtagcaaatcgtgatgtaaattttttactgctggtcatggtcaaaaagtaagatacgctaggaaattgagtcactaggagcatggatgtataaggcaggttttatagaaccatttagattcaacattaatggtagagtggcattttaccaaaaaaatgggtgtatttgatttgggtgctgtaaggcaatttgctaggacatgggataatcagattacacaaaatctaggcagtgaacaagtcttcatcctggcccaggaaatagcctattaaaaaatgctgtccaggccaggcacagtggctcacacctgtaatcccaggacttcgggaggctgaggctggaggattgcttgagttcaagaccagcctgagcaacacagtgaaaacccatctcaaaaa

SEQ ID NO: 320185 - DNA, 2755 bp, Homo sapiens
cttcctgaaggtcgaggcacgctttcccaacatgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagtgaagccgccctgaaggaacgaattgagctcagaaaagtcaaagcctctgtggacatgtttgatcagcttttgcaagcaggaaccactgtgtctcttgaaacaacaaatagtctcttggatttattgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagcaccgagcttatgagcaggcattaaacttgtacactgagttactaaacaacagactccatgctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaatagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctagaagtgagttgctgaatgagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatggtctcaccatagctgctggaatcacacctgagaactgagatataccaatatttaacattgttacaaagaagaaaagatacagatttggtgaatttgttactgtgaggtacagtcagtacacagctgacttatgtagatttaagctgctaatatgctacttaaccatctattaatgcaccattaaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagc

SEQ ID NO: 320186 - DNA, 5426 bp, Homo sapiens
cttcctgaaggtcgaggcacgctttcccaacatgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagtgaagccgccctgaaggaacgaattgagctcagaaaagtcaaagcctctgtggacatgtttgatcagcttttgcaagcaggaaccactgtgtctcttgaaacaacaaatagtctcttggatttattgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagcaccgagcttatgagcaggcattaaacttgtacactgagttactaaacaacagactccatgctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaatagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctggaaaatgttggggcttttcaggaagcataataagattcctagaagtgagttgctgaatgagcttatggacagtgcaaaagtgtctaacagcccttcccaggccattgaagtagtagagctggcaagtgccttcagcttacctatttgtgagggcctcacccagagagtaatgagtgattttgcaatcaaccaggaacaaaaggaagccctaagtaatctaactgcattgaccagtgacagtgatactgacagcagcagtgacagcgacagtgacaccagtgaaggcaaatgaaagtggagattcaggagcagcaatggtctcaccatagctgctggaatcacacctgagaactgagatataccaatatttaacattgttacaaagaagaaaagatacagatttggtgaatttgttactgtgaggtacagtcagtacacagctgacttatgtagatttaagctgctaatatgctacttaaccatctattaatgcaccattaaaggcttagcatttaagtagcaacattgcggttttcagacacatggtgaggtccatggctcttgtcatcaggataagcctgcacacctagagtgtcggtgagctgacctcacgatgctgtcctcgtgcgattgccctctcctgctgctggacttctgcctttgttggcctgatgtgctgctgtgatgctggtccttcatcttaggtgttcatgcagttctaacacagttggggttgggtcaatagtttcccaatttcaggatatttcgatgtcagaaataacgcatcttaggaatgactaaacaagataatggcagtttaggctgcacaactggtaaaatgactgtagataaatgttgtaattagtgtacacgtttgtatttttgttaatatagccgctgccatagttttctaacttgaacagccatgaatgtttcatgtctccctttttttttgtctatagctgttacctattttagtggttgaaatgagagctagtgatgacagaaggatgtggaatgtcttcttgacatcattgtgtattgctggtaatcaagttggtaacgactacttctagcagctcttaccactatgacttaagtggtcctggaaggcagtaagtggaggtttgcagcattcctgccttcatgagggcttctaccactgaccactttgcacgtacctggctcccagatttacttaggtaccccacgagtcgtccacataagcagcttcatctttaccttgccagagttgacaattatgggatactctagtctacttatacttgtgttcccatctgtctgccatcctctgaaggccaggacccagtcatacatccttagaaaccaaagtatggtttttgttttctcttggaatgtcaggtcttaaggcatttaattgagggacaaaaaaaaaaaaagccgatatagtagctagctacttaagcatccatgggtattgctccatatcaaagcagatttgcaggacagaaagagtaaattagccttcagtcttggtttacagcttccaaggagagccttggccacctgaaatgttaactcggtcccttcctgtctctagttcatcagcacctgcagatgcctgactcttgttagccttactattcaatacagtccttagattcacggtatgcctcttcctatccaggcacctattctgaatcaccatgttgctctgcagctagagttgataggagaaaatccatttgggtagatggcctatgaatttgtagtagactttcaaaatgagtgatttgttagcttggtacttttaagtttgtggtacagatcctccaaacccatactctgagcaattaactgccttgaacatagagaaaaattaaggcctcacaggatgagtctccattctctgtaaatgcttattttatcatagtctttagcctctactatgagtaaaatgttctcttcggccgggtgtggtgactcacacctgtaacctcagcactttgggaggcagaggtgggaggatcacttaggtccaggagttcgagactagcctgggcaacatagtgagacaccggatctacaaaaaaataaaaagccagactggtggtatgtatctgtgtcccagctaattgggagggtgagatgggaggattgtttgagcctaggagagggaggttgcagtgagccgtgattgcaccactgcactccagcctgggcaacagagcaagaccctgtcttggagaaaccagaattttggaagagcaaatggggctgagtgcagtggctcatgcctgtaatcccagcacttagggtgccaatgtggattacctgagcccaggagtttgagaccagcctgggtaacagtgagacccccctccctacaaaagattttaataattagttgggcgtagtggtgcatgcctgtaatcccagctactctggagacaggtggaggggattgcttgagcctgggaagctgaggctgcagtagccatgactgcaccactgcattccagcctggttgacagagtgacccttgtctccaagaaaaaaaaaaagcaaatgggattaaggactcatggaatgggaaggggaaggggagtcttactatatgtggaataaacttgctcagtgttgccacagagttacattaccaatgtgtagaagtcagaaactagacttctagtttggttcaacatttgagggttgttttatagccatcaaagtattcaagaggttggatggcactcaaaagattctacatgtctagaatcaaactcaaatctggcacgtaggtgcttcttagtaaatgcttaatgaatgccaccaactctgcaaagtattcattgattttgagaccttagtcatgttgctactaaaagtagggcatatgaccgcctaagaaacagaacttcgagaagtcctaacgtaaccacagtaaagcagactcccctttcagcaacctcaaagcaaaaaaaaaaaaaaaaaaaccagttagctgctatataaacactataccaagcactaggcttagaggaaaagatgtcagattgtactgtcactggctatgtacccatattctctaagacagggtagcatttgtctttcaaactgcagggtttgaaatcagtttttgtgggtgattgcaattttttaatgaaatgcattagaacatctaagcacgtcacctacagttttgtgatggtgcatttttgcattgcagtatagatctgtgcatagatatatgcattaagtgtagcaaatcgtgatgtaaattttttactgctggtcatggtcaaaaagtaagatacgctaggaaattgagtcactaggagcatggatgtataaggcaggttttatagaaccatttagattcaacattaatggtagagtggcattttaccaaaaaaatgggtgtatttgatttgggtgctgtaaggcaatttgctaggacatgggataatcagattacacaaaatctaggcagtgaacaagtcttcatcctggcccaggaaatagcctattaaaaaatgctgtccaggccaggcacagtggctcacacctgtaatcccaggacttcgggaggctgaggctggaggattgcttgagttcaagaccagcctgagcaacacagtgaaaacccatctcaaaaa

SEQ ID NO: 320187 - DNA, 2101 bp, Homo sapiens
cttcctgaaggtcgaggcacgctttcccaacatgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagtgaagccgccctgaaggaacgaattgagctcagaaaagtcaaagcctctgtggacatgtttgatcagcttttgcaagcaggaaccactgtgtctcttgaaacaacaaatagtctcttggatttattgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagcaccgagcttatgagcaggcattaaacttgtacactgagttactaaacaacagactccatgctgatgtatacacatttaatgcattgattgaagcaacagtatgtgcgataaatgagaaatttgaggaaaaatggagtaaaatactggagctgctaagacacatggttgcacagaaggtgaaaccaaatcttcagacttttaataccattctgaaatgtctccgaagatttcatgtgtttgcaagatcgccagccttacaggttttacgtgaaatgaaagccattggaatagaaccctcgcttgcaacatatcaccatattattcgcctgtttgatcaacctggagaccctttaaagagatcatccttcatcatttatgatataatgaatgaattaatgggaaagagattttctccaaaggacccggatgatgataagttttttcagtcagccatgagcatatgctcatctctcagagatctagaacttgcctaccaagtacatggccttttaaaaaccggagacaactggaaattcattggacctgatcaacatcgtaatttctattattccaagttcttcgatttgatttgtctaatggaacaaattgatgttaccttgaagtggtatgaggacctgataccttcagcctactttccccactcccaaacaatgatacatcttctccaagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagccaacccatcagacagactgctcaggattggccagccacctctctcaactgtatagctatcctctttttaagggctgggagaactcaggaagcctgctggaagtagccacatttggaatttcttcaccagccttagccaccacatttgggcactcttctgttaggcaagcataccgtcaactccctactatccagggcatcctgaggcaagcagttttttatctgtgttcacggatcatcatacattggggctacattgaatagatcatcatgaagtcatactgaatgaatgttgataatccatttggccctttagactttctaacctcactggaaacaagtaaaaataaatgttagacttcatct

SEQ ID NO: 320188 - DNA, 1090 bp, Homo sapiens
cttcctgaaggtcgaggcacgctttcccaacatgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagtgaagccgccctgaaggaacgaattgagctcagaaaagtcaaagcctctgtggacatgtttgatcagcttttgcaagcaggaaccactgtgtctcttgaaacaacaaatagtctcttggatttattgtgttactatggtgaccaggagccctcaactgattaccattttcaacaaactggacagtcagaagcattggaagaggaaaatgatgagacatctaggaggaaagctggtcatcagtttggagttacatggcgagcaaaaaacaacgctgagagaatcttttctctaatgccagagaaaaatgaacattcctattgcacaatgatccgaggaatggtgaagcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtga

SEQ ID NO: 320189 - DNA, 653 bp, Homo sapiens
acaacagaatagaaaatggttttagggctaatgtacctgtgggtgacttcatttgccagattttatatagggttctttttatttctcatcttaaaacaaatttatgtattactgcctggcatagacaccaggtgttcaacaaatatttgttgaatggataatgaatgggtatttgaatggaaatgaacttctaaaatttcattttagatagcttgtgtatttaagagtctacatgtagatggtcaggagttgacttttattcataaaaatgactctttaatgggtaaaaatgaggacagaaagaaagctgggtttcccctaagataacattactttatgccaagctagggtacttgtttcaagttttttaaaaattaaaaaaaagaaaattaaaggtgtgagatactagctcctgtgatgtcatatggaagcctttttctacttttccagtctctaggctacttcttatttcttctattaccgaaactctcttgctttcactgggctttcaaggtgtgagctcttcatgtgaggattctctgactgtgattttctccaaagtgatctcaggcagtaacttcatttcttttcggtgaggtaaatgctttgtcagcattttaaaatcatattcttaaaaaaaaaataatttattt

SEQ ID NO: 320190 - DNA, 294 bp, Homo sapiens
cccatctccctctgaagccactaagctgcttctctccactttacagcagcaaaatttccctaacgagctgtcgatattcacctcacttcctattctctcttcgaagcatcccaatgtggcttggaccacttgtcaaaacagtcaccatcatgttgtcaaatccaaatagacatttctctattctcattgtgtaacttctcagcagcatttgacagaggtgaccattccctctttcttgaaaataataaaatactctcccactttaatggctgaaccttttcagtctcctttgcc

SEQ ID NO: 320191 - DNA, 620 bp, Homo sapiens
acacagtcttgctctgtcggctgggttggagtgcaacaatgtgagtacagctcaccacagcatcgacctcccagtctcaagtgatcctcttccctcagcctcttgagtagctaggactgcaggtgcatgccaccatgctttttcttatttttgtaaagacggagtcttgccattctgctcaggctggtcttgaactagtaggttcaagtaatcctcccaccttggcctcccaaagtgctgggattacaggtgtgagccactgcgtccagcctatatgtatttagatatataccatctatatataaaccaatcaagattggtttacatataaagaatggcttataataacagcagttactgattttatggaccttaaaagtcactgatggaactaaaatcaagagaatgaaaatgtgaaatgggatttgcaattaaaaataatccagctcttcctgccatcatgaagcctgtcgaggcctgcttggaacatgacttctaaaaggcaagtatttctggaaggctgtcatccaaggccatttttgcgctataagcagggtctctggaaccaaagggagcacacaaatcttcttaaaactgaaggtgtttatgcccaagatgaa

SEQ ID NO: 320192 - DNA, 1253 bp, Homo sapiens
aaccaaaaaaactgtccagctgtggactttcaggattcaggactgctggggatcaagcccaaggatgtttttcagagctctgtgatttaagatgctcgaaaagagtgtccaagaggagtaaaggtcatgacagaatttactcccaggacaatctaagttctgccacaagtacccgtggtgtctgttcccacaacaatggccctttcacaagctcttgcctcacaacccctgcagaagtccttcaacaaaactaataatagactagtgaaacctactcctcacatgggtaagagttgcagtgggcaggtgaccctcctccctgcccccatcctttgcttcctcaagctccctgccaacctctggatacatcaatgggaaggaaaccagggaagcatagacctatagtacaacaggggtgtagtgaccactggacctgatgaagcgaatctgcctgaaatttaatacgcctttttatttcccttctgtgttaaatcaaatgatctgttctgcactgagccaagcaagttacttttaaaactggtggcaccactcatttgggacttggagactgcttttatccagaacctgttaagagaacaggggatttaaatacaaaggaatatgaaggtggtgtgccttaaagacagtctaaaattaggttttagtttgttacattattttgaaatattaaacatgaaaatgttaaatcaggatgtgtgagttttaagatgttgaacactgtcctacatcagtgaggagggaggcaataaagtaatttcagagtaaaacagattgaggatgaaaccaagacagaagtgatgatttggctttttatgatttttgctgtggaaatggcagtcgtgtgacttttcacttgcagtttaaatgaaagggtgaagagaagcctacctgccctaatggctcagggctatatccacctcccggataaccctggcccttgggactccatcatctccttgaagtagcactgagaatccaagaagaggctccgctgctttttgcacatgttactgagttacatctcaggaagatttttaagcacgaggaaggaaaatacaggcctggccaagcagggtccccttttcggtatcatctttgttcctaataagcaatcaagggggtgggtgtgttggctggtaaaggaactactaagattcagaagcttgtagtcttcattattttgttttacaggttaaaataaaccacttgactgggcacggtggctcacacct

SEQ ID NO: 320193 - DNA, 1019 bp, Homo sapiens
  misc_feature (761)..(761): n is a, c, g, or t
  misc_feature (868)..(868): n is a, c, g, or t
  misc_feature (874)..(876): n is a, c, g, or t
caccactatcaacccaagaagtggcctgatgagagaaagatcgatgggcaagaaagaatgctgggcttttcattcttgcttttggcacaggatcttttagaacttaagcacaaagcgggagatacttcacagagcagttctaagaattaactgggataattaaaattgaacctaccacatacccatgagcaaattccattgctcccagcattataattgttagtagccatgtcctttcaccaagcatgaacttgaatcaatgtcaacgttattagcgatagaaaggaccacttgctctctctgccagtattccctgcttatctcctgaggagataaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcttatctggtactgcccattgngagatggggacattgggacctcagcaatgaagaacccttgtgaagtaaccaggaggaatggggaaagaagcaagttgggcaggatatggcctacttccataggcttntctttnnncaggtttgatgtaagcatgggcttacatcccccaggtacatacttttacttattgtgggatacctggcactagtaggcaggtaagtcacaattggtgtctttcaccttttgactgttgaattaatagctcctctcactctgcc

SEQ ID NO: 320194 - DNA, 1801 bp, Homo sapiens
aaagaactgaatcaggcaccccaagaatgtcaatttcttacattctcaccctaaggactcttaattccatctgtagtgaccaagttatggcttaggaagtttcatgttgggaagatggtacatggtcctcatttatagcaaccttttagttagaaatgaatcatatttatattctatgatgacagctgttccctgagagtgaaaggtacattttgtccagaggcagcaatagaacagtagccttctttgtccatcttttctcggcgtaagacccagttctggggcctgaaggctaattggcccacttgaaggaatctctgatttctgcctgcattccaacattggcaccaaaatgtagccatggagatttaagaattcagtgctgtggcttgcttctcttggtgtacaagttatcctctgcaacctgtgtcttcaactttttgtagttctcaactatgtcagttatctcattattttaggacattatcctacttgaaatatagtcattctcacgtcattcctgtcctcgttatccattgaaaactgagctttctcttcaatttggatcgaattcaaagattcagaagccctaatggtatgtaattgagtgcactgagggcttcagttttcccttagagaaaatgggacaaataccagcctgcataggtgtttagacaggccaggaaggcttaggccatatagattctgaggacccaagctgaaaatagtgtcatttcggtgtgtacaaggatcagggaggacgtagatgtctcctctaggttttataaggccactttacagaagtagttatataaaaggtaaacatttgtgcgtaggctgtgttgccagtttgggcattaggagaaattctaattcctcattttccctttggctattaattctgtttaatatgctcagactgaccataccaccacccgcagatgggtattgcagcattggaacaggtgctgagtatagtaggaactttgtttggtggccatgtgacaggtggcttaatagacccttttgggtaaaacttcttaactgcatttaggtttcttccatgctctgctttctgttctggcctggccacgtgactcctgcttagtgttagtatgtttcctggttcctcacctatggctgtcatgcgaggaaagacttaaaatctcgagttttagtacacttggaaaacctctggggctgtgtttgtgtacacacatactcataaaggcacttttagccaggactcctttaaaaagaaaaaagaaggatttaagagtttcctgtgtatgtgcatcctgcctgctagggcctcttgggtgtttggggattaatggatttggttgtgtacatacttgttttcttaccactaaacctcccatttccagatttttccccctccccttaaggtaagctatgacttgcacagaatagacttcttaacctatatttaaactcaccttattcccttttagcaacttttcttgaaatatgtcacagtttccatacttttgcagccaaagtctccttttcagtcgaacgttcagagacctcattttgttctgttttttcaccgaatctttatagtggatgtcactgctttttttctctctactcacagtagcttctcctccagccattcctcaccacttctagtgtcagacagtcctgctttgttttcccagacttgcattctctgtctgcattccttacttcttatgttgtagcgttagaatatgtgtgttttatataagcccctgtcattcagaaagtaacctctaacttgtgttttctttctttt

SEQ ID NO: 320195 - DNA, 3632 bp, Homo sapiens
cggcggcggggggggcgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgtgagtgtgtccgagtcccaagagggggaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcattgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaaggaaaaaaaacacccatccctcaaaaaggccaaggtcccgtccccctgttgtcggtgatttgtttgtctttctgataggttgaaaattgtgtaataaacttgatgacgctgtcaatcttttatactgcattgtatttttttccttttgtaacaaaatatttttaaataataaatggggtgtgagctgttttatggaaaaaaaatt

SEQ ID NO: 320196 - DNA, 4171 bp, Homo sapiens
tgctttttctgccatcttgttactgcccctgaccctggggctttatgtctagcagggtcatctgagggacgagatttcagagtgaacaccttgaactcttggtggtcattagatggtcctgtgataatggtgggtgatggggattaaagaccttgataactctagtatacttggggtaggtggtgactgttgttctgcaagttattttgtgatgttttggggctggtggtgggggtggtttttccaaattaggaagtatatttactgtgggggaagttctggcaatggtcaactctagcctgacagatctataattaaaaaattgctagctgtcaatgtttgaactgatgaccagccagcccaaacggcagtcaaagttacaataagttttaatcttcgtaatctctaaagatggagattgggggtgagtgggtttggaattctgtatgggtgaggacaataagaaaagtctgcactaattgaaatattgccaggcttttgagtttcctctggggggacttagttgtgactagaatcctgggtttgggacattggcgggcgggggtgtagctcttgacatctcttccttttccatcttgccggccccagtggaccacagaccagcagctgatccaggttattcgctctataggagtctatgatgtggtggagttgaaatttgcagagaatcgagcaaatggccagtccaaagggtgaggtctggatttgagaagccccttttaatttgtaaccattgggataaaagatctgtactatattttggccctggattttaatcactcccacccctggcccagcttactgccttggttttggcaaactgccttagaaagggacctagctgcagtgtagtagaatatccatctgttaaggggcgaagaatactgatttttaattccaaaaaaataaagatttaggctgtctctttgttgtcagtgctgtatgtgtgtttagtttagcaagatgtcctttgctttatcaatttttactaaaagtggaagagaatttcttttttcttctcttggctgtctacagatttcattcatttttaatttttctttcctaaggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcattgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaaggaaaaaaaacacccatccctcaaaaaggccaaggtcccgtccccctgttgtcggtgatttgtttgtctttctgataggttgaaaattgtgtaataaacttgatgacgctgtcaatcttttatactgcattgtatttttttccttttgtaacaaaatatttttaaataataaatggggtgtgagctgttttatggaaaaaaaatt

SEQ ID NO: 320197 - DNA, 3671 bp, Homo sapiens
cggcggcggggggggcgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctgggttggattgatctctgaaagagaactatcctgaggacgtactggtgccgaagaaagcaatgattaatggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcattgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaaggaaaaaaaacacccatccctcaaaaaggccaaggtcccgtccccctgttgtcggtgatttgtttgtctttctgataggttgaaaattgtgtaataaacttgatgacgctgtcaatcttttatactgcattgtatttttttccttttgtaacaaaatatttttaaataataaatggggtgtgagctgttttatggaaaaaaaatt

SEQ ID NO: 320198 - DNA, 3086 bp, Homo sapiens
cggcggcggggggggcgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcattgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaaggaaaaaaaacacccatccctcaaaaaggccaaggtcccgtccccctgttgtcggtgatttgtttgtctttctgataggttgaaaattgtgtaataaacttgatgacgctgtcaatcttttatactgcattgtatttttttccttttgtaacaaaatatttttaaataataaatggggtgtgagctgttttatggaaaaaaaatt

SEQ ID NO: 320199 - DNA, 2827 bp, Homo sapiens
  misc_feature (86)..(86): n is a, c, g, or t
caagaaaggaaccgggagcatgagagacaccgggatagagaacgggaccggcaccactgagaaaggagtctggttggaagcaaatntttttttaatggacttgcatctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcattgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaaggaaaaaaaacacccatccctcaaaaaggccaaggtcccgtccccctgttgtcggtgatttgtttgtctttctgataggttgaaaattgtgtaataaacttgatgacgctgtcaatcttttatactgcattgtatttttttccttttgtaacaaaatatttttaaataataaatggggtgtgagctgttttatggaaaaaaaatt

SEQ ID NO: 320200 - DNA, 3551 bp, Homo sapiens
cggcggcggggggggcgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcattgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatggacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaaggaaaaaaaacacccatccctcaaaaaggccaaggtcccgtccccctgttgtcggtgatttgtttgtctttctgataggttgaaaattgtgtaataaacttgatgacgctgtcaatcttttatactgcattgtatttttttccttttgtaacaaaatatttttaaataataaatggggtgtgagctgttttatggaaaaaaaatt

SEQ ID NO: 320201 - DNA, 2661 bp, Homo sapiens
aaagaactgaatcaggcaccccaagaatgtcaatttcttacattctcaccctaaggactcttaattccatctgtagtgaccaagttatggcttaggaagtttcatgttgggaagatggtacatggtcctcatttatagcaaccttttagttagaaatgaatcatatttatattctatgatgacagctgttccctgagagtgaaaggtacattttgtccagaggcagcaatagaacagtagccttctttgtccatcttttctcggcgtaagacccagttctggggcctgaaggctaattggcccacttgaaggaatctctgatttctgcctgcattccaacattggcaccaaaatgtagccatggagatttaagaattcagtgctgtggcttgcttctcttggtgtacaagttatcctctgcaacctgtgtcttcaactttttgtagttctcaactatgtcagttatctcattattttaggacattatcctacttgaaatatagtcattctcacgtcattcctgtcctcgttatccattgaaaactgagctttctcttcaatttggatcgaattcaaagattcagaagccctaatggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaaggaaaaaaaacacccatccctcaaaaaggccaaggtcccgtccccctgttgtcggtgatttgtttgtctttctgataggttgaaaattgtgtaataaacttgatgacgctgtcaatcttttatactgcattgtatttttttccttttgtaacaaaatatttttaaataataaatggggtgtgagctgttttatggaaaaaaaatt

SEQ ID NO: 320202 - DNA, 3491 bp, Homo sapiens
  misc_feature (3425)..(3425): n is a, c, g, or t
  misc_feature (3433)..(3433): n is a, c, g, or t
  misc_feature (3490)..(3490): n is a, c, g, or t
cggcggcggggggggcgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcattgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaagcacctcctcaaaaggcaggtccgnccctgtgncgggttggttgcttctgtggtgaattggtataattgtgagtgcatcttttctgatgnt

SEQ ID NO: 320203 - DNA, 3160 bp, Homo sapiens
  misc_feature (2902)..(2902): n is a, c, g, or t
  misc_feature (3009)..(3009): n is a, c, g, or t
  misc_feature (3015)..(3017): n is a, c, g, or t
cggcggcggggggggcgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcattgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcttatctggtactgcccattgngagatggggacattgggacctcagcaatgaagaacccttgtgaagtaaccaggaggaatggggaaagaagcaagttgggcaggatatggcctacttccataggcttntctttnnncaggtttgatgtaagcatgggcttacatcccccaggtacatacttttacttattgtgggatacctggcactagtaggcaggtaagtcacaattggtgtctttcaccttttgactgttgaattaatagctcctctcactctgcc

SEQ ID NO: 320204 - DNA, 1914 bp, Homo sapiens
cggcggcggggggggcgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcattgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggtggggagaagccccgttcctggctgctgggggattttttattaaaaaaagatttatagtgaagaattctctctctttaaagcaaaagtaaatgcagcaagggtagggggaacttctgatttacataactggaatttcagggcagattttctgcacatttatggggagtcttaccctgagattcagctgtttctgcttgtttcttgactgccttaacctggtatctgagtgagagtatggtgtctgcattcaggtaccaatttgaatcccagtttctccactaataattggccatattactttctgttccacagtttcatttgtaaatgaagataataaaagcaactgtcccagtgacttgctaagttttagtga

SEQ ID NO: 320205 - DNA, 1494 bp, Homo sapiens
cggcggcggggggggcgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggtaactcagtgcttacctttgctgccttctccttaacctttacttttttttcctgattttgtcatttctactggcaaaagttcaacaagataaagttggagtactgtagatatcaagagcggcatactttgaagagcaatatgtaacctgatttcttggccttggggaagctccggcagtattacttagtctgtatctaggcctgccctcatgaaaaccaacttaatgcctagaatataaataattaataccatctcgatgtggtgtcagggatcctctagatacaccagga

SEQ ID NO: 320206 - DNA, 1120 bp, Homo sapiens
cggcggcggggggggcgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgtgagtgtgtccgagtcccaagagggggaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctggtcgagcggccgttaatttagtagtagtaggc

SEQ ID NO: 320207 - DNA, 353 bp, Homo sapiens
atggggattcatcatgttgaccaggctggcctcaaactcctgacttcaagcgatctccccgctttggcctcccaaagtgctgggattgcaggtgtgagccaccgcgcctggccctaaatagattttttaaaatggatgcttagcaagaagaaaaaaaacacccatccctcaaaaaggccaaggtcccgtccccctgttgtcggtgatttgtttgtctttctgataggttgaaaattgtgtaataaacttgatgacgctgtcaatcttttatactgcattgtatttttttccttttgtaacaaaatatttttaaataataaatggggtgtgagctgttttatggaaaaaaaatt

SEQ ID NO: 320208 - DNA, 345 bp, Homo sapiens
gtgagtgtgggtaaccaaaaatgcttaggggtgggctggagggagagcactgggaggtgatggcattttcagaaactactgttgcactgttttgtgctctgatggggttggatttctttttcctgggatcaggttggattgatctctgaaagagaactatcctgaggacgtactggtgccgaagaaagcaatgattaagtgggtagttgctttttctgccatcttgttactgcccctgaccctggggctttatgtctagcagggtcatctgagggacgagatttcagagtgaacaccttgaactcttggtggtcattagatggtcctgtgataatggtgggtgat

SEQ ID NO: 320209 - DNA, 3605 bp, Homo sapiens
cggcggcggggggggcgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcattgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaaggaaaaaaaacacccatccctcaaaaaggccaaggtcccgtccccctgttgtcggtgatttgtttgtctttctgataggttgaaaattgtgtaataaacttgatgacgctgtcaatcttttatactgcattgtatttttttccttttgtaacaaaatatttttaaataataaatggggtgtgagctgttttatggaaaaaaaatt

SEQ ID NO: 320210 - DNA, 3567 bp, Homo sapiens
gaggaggcagagcgcgccgggccggtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgtgagtgtgtccgagtcccaagagggggaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcattgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaaggaaaaaaaacacccatccctcaaaaaggccaaggtcccgtccccctgttgtcggtgatttgtttgtctttctgataggttgaaaattgtgtaataaacttgatgacgctgtcaatcttttatactgcattgtatttttttccttttgtaacaaaatatttttaaataataaatggggtgtgagctgttttatggaaaaaaaatt

SEQ ID NO: 320211 - DNA, 3528 bp, Homo sapiens
cggcggcggggggggcgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctgggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgtgagtgtgtccgagtcccaagagggggaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcattgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaaggaaaaaaaacacccatccctcaaaaaggccaaggtcccgtccccctgttgtcggtgatttgtttgtctttctgataggttgaaaattgtgtaataaacttgatgacgctgtcaatcttttatactgcattgtatttttttccttttgtaacaaaatatttttaaataataaatggggtgtgagctgttttatggaaaaaaaatt

SEQ ID NO: 320212 - DNA, 3404 bp, Homo sapiens
cggcggcggggggggcgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatggtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcattgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaaggaaaaaaaacacccatccctcaaaaaggccaaggtcccgtccccctgttgtcggtgatttgtttgtctttctgataggttgaaaattgtgtaataaacttgatgacgctgtcaatcttttatactgcattgtatttttttccttttgtaacaaaatatttttaaataataaatggggtgtgagctgttttatggaaaaaaaatt

SEQ ID NO: 320213 - DNA, 2764 bp, Homo sapiens
gcactgaatccttgttctttcccttatagacattctgttatcatagcattgactcctgggaagtagtaccatgtcctttatacccctttttaaggtgcttaattaaatgcgggagcaggtgttatgaatgctacagatgtctagcattgttctgtgttatgccaaaattaccaaagtgttgtagagtacagtaaaaataataagggatgtgagcaatcaaggatggtattttctctgtacagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcattgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaaggaaaaaaaacacccatccctcaaaaaggccaaggtcccgtccccctgttgtcggtgatttgtttgtctttctgataggttgaaaattgtgtaataaacttgatgacgctgtcaatcttttatactgcattgtatttttttccttttgtaacaaaatatttttaaataataaatggggtgtgagctgttttatggaaaaaaaatt

SEQ ID NO: 320214 - DNA, 3491 bp, Homo sapiens
cggcggcggggggggcgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggggattacagtgacgcaattgagacgctgctcacagccattgcggttatcaaacagtcccgggttgccaatgatgagcgttgccgtgtcctcatctcctctcttaaggactgtcttcatggcattgaagccaagtcctacagtgtgggtgccagtgggagctcttccaggaaaagacatcgctcccgggaaaggtcacctagccggtcccgggagagcagcaggaggcaccgggatctgcttcataatgaagatcggcatgatgattatttccaagaaaggaaccgggagcatgagagacaccgggatagagaacgggaccggcaccactgagaaaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgtttgtctttctgataggttgaaaattgtgtaataaacttgatgacgctgtcaatcttttatactgcattgtatttttttccttttgtaacaaaatatttttaaataataaatggggtgtgagctgttttatggaaaaaaaatt

SEQ ID NO: 320215 - DNA, 1464 bp, Homo sapiens
caccactatcaacccaagaagtggcctgatgagagaaagatcgatgggcaagaaagaatgctgggcttttcattcttgcttttggcacaggatcttttagaacttaagcacaaagcgggagatacttcacagagcagttctaagaattaactgggataattaaaattgaacctaccacatacccatgagcaaattccattgctcccagcattataattgttagtagccatgtcctttcaccaagcatgaacttgaatcaatgtcaacgttattagcgatagaaaggaccacttgctctctctgccagtattccctgcttatctcctgaggagataaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtcttttcaccttttgactgttgacttaatagctcctctcactctgcctggagatacttcctgcctcagatgaggagccagaagaaacagagcccgacttgaatgaactcagctcagagttctaaggaccagcattctgggggccattttctctacaggcaaatggaattgcttttccataacatccaaattgtaatgtggttgctgctgaaggaggaggcagcagcgaggtcctgcggtacccatggggtgatgctacttctgcatgcatctacagggcatctgacacctaacatgagacgtggcatgtgagatgagacttggcatgtgagacatagggtcactagagacccttctgggtcagaggagagagactgaattggactaaacccgtcctctgttcccagcacgtttctcatatagccctcagtcactgagggagtcccccgcaggattggagaggcacattcccttgggacagaggctacaggttggagctttttttcccctgtcccccaaccccatccccacctccacttcagaacatggcaccccacccaactggccaagtgttaagtgatgtgcttattgagagcaactccgggtgtcttttaaaatgtagagaaaaggtgacagtttaaggaaaaatatatatagaataccagaaatgccgtttacccggagaatttttttctccccatttgttttgtttttactcaatgacaccatttttagttttatttcctgatagcaaaaggaaaaaaaacacccatccctcaaaaaggccaaggtcccgtccccctgttgtcggtgatttgtttgtctttctgataggttgaaaattgtgtaataaacttgatgacgctgtcaatcttttatactgcattgtatttttttccttttgtaacaaaatatttttaaataataaatggggtgtgagctgttttatggaaaaaaaatt

SEQ ID NO: 320216 - DNA, 1985 bp, Homo sapiens
cggcggcggggggggcgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagcccaacaacaagacccctgcaattctgtatacctacagtggcctgcgtaatagacgagctgccgtttatgtgggcagcttctcctggtggaccacagaccagcagctgatccaggttattcgctctataggagtctatgatgtggtggagttgaaatttgcagagaatcgagcaaatggccagtccaaagggtatgctgaggtggtggtagcctctgaaaactctgtccacaaattgttggaactcctaccagggaaagttcttaatggagaaaaagtggacgtgaggccggccacccggcagaacctgtcacagtttgaggcacaggctcggaaacgaatacctccacgggcccattcccgagattctagtgattctgctgatggacgggccacaccctctgagaaccttgtaccctcatctgctcgtgtggataagccccccagtgtgctgccctacttcaatcgtcctccttcggcccttcccctgatgggtctgcccccaccaccaattccacccccaccacctctctcctcaagctttggggtccctcctcctcctcctggtatccactaccagcatctcatgcccccacctcctcgattacctcctcatcttgctgtacctccccctggggccatcccacctgcccttcacctcaatccagccttcttccccccaccaaacgctacagtggggcctccaccagatacttacatgaaggcctctgccccctataaccaccatggcagccgagattcgggccctccaccctctacagtgagtgaagccgaatttgaagatatcatgaagcgaaacagagcaatttccagcagtgccatttccaaagcagtatctggagccagtgcaggtaactcagtgcttacctttgctgccttctccttaacctttacttttttttcctgattttgtcatttctactggcaaaagttcaacaagataaagttggagtactgtagatatcaagagcggcatactttgaagagcaatatgtaacctgatttcttggccttggggaagctccggcagtattacttagtctgtatctaggcctgccctcatgaaaaccaacttaatgcctagaatataaataattaataccatctcgatgtggtgtttgctgtagagtgaaattcctgccttgtggaaatctccatctcagtggttgatctttagatctagtgtctgtgtagtagacccaataccagatatagaccctgggtcttctttaggaatgatgttttgactggataatgtgttttttgttgttgtttgagagggagtcttgccctgtcgcccaggctggagtgcagtggtgcagtcttggctcactacggcctccacctcctggtttcaagcgattctcctgcctcagcctcccaagtagctgggattgcgggcacttgccaccacgcccggctaatttttgtatttttttgtagagacagggtttcatcatatgtggccaggatggtcttgaactcctgaccacaggtgatccgcctgtctcggcctcccaaggtgctgggattacaggtgtgagccaccacgtccagcctagataatggtttgctatgaaatctgattacatttaggagtctaagcagagctggtaggtagcctatcctaaaaa

SEQ ID NO: 320217 - DNA, 341 bp, Homo sapiens
cggcggcggggggggcgggacctggggcggagagcggttcgcgcgcttcgggcctagtccggactcgccgccgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccaccacgacgaattccggacgaccacgacgaattccggcacgacg

SEQ ID NO: 320218 - DNA, 3252 bp, Homo sapiens
ggcacgaggcgcgcacgcagccagcgagcggccggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcaggtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagc

SEQ ID NO: 320219 - DNA, 906 bp, Homo sapiens
attctgctgctcctcttcagaaggacatggacagtcgagacattcctgcgcatggtgcagtgccgctcgtggagggcagctgtggcttctaggtgcccgagtagcatcctgtgaccctccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggaggtgccgatggtggtggtgcccccagtgggtgccaagggcaacacaccagccactggcactactcagggcaaaaaggcggaggggactcagaatcaaagcaaaaaggctgaaggagccccaaaccagggcagaaaggcagagggaaccccaaaccagggcaaaaagacagagggaaccccaaaccaagggaaaaaggcagagggaaccccaaaccaaggcaaaaaggcagaaggaaccccaaaccaaggcaaaaaggcggagggggcccagaaccagggtaaaaaggtagatacaaccccaaaccaggggaaaaaggtggagggggccccaacccagggcagaaaggccgagggggctcagaaccaggccaaaaaggtagaaggggcccagaaccagggcaaaaaggcagagggggcccagaatcagggcaaaaagggagagggggcccagaaccagggcaagaaggccgagggggcccagaatcagggcaagaaggccgagggggcccagaatcagggcaagaagccgaggggcccagaatcagggcaagaagccgaggggcccagaatcaggcagaaggctgagggg

SEQ ID NO: 320220 - DNA, 395 bp, Homo sapiens
tttttcaagttttatgatttatttaacttgtggaacaaaaataaaccagattaaccacaaccatgccttactttatcaaatgtataagaagtaaatatgaatcttatatgacaaaatgtttcattcattataacaaatttccaataatcctgtcaattatatttctaaattttcccccaaattctaagcagagtatgtaaattggaagttaacttatgcacgcttaactatcttaacaagctttgagtgcaagagattgaagagttcaaatctgaccaagatgttgatgttggataagagaattctctgcccctcacccctagacgttgccaaccagaactgacgtgtgacctcctgggtgttgatgccattaaaaccaacgttggtgcccggtg

SEQ ID NO: 320221 - DNA, 3745 bp, Homo sapiens
ggcacgaggcgcgcacgcagccagcgagcggccggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcagaaagaagcttccggttctgaggtcctggaggtgccatttccctctctgttgaagcaaaggccggggcagacctcctagtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320222 - DNA, 3821 bp, Homo sapiens
  misc_feature (3578)..(3578): n is a, c, g, or t
  misc_feature (3820)..(3821): n is a, c, g, or t
catgttgtcgtgacttttgagtacgccaggcttaggctgcagttatttgaactcgagaggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtgaaaaaaaaaacaagaaacgaaacaaaaaaaaggggcagaccgaagaaaagataccccaggaaggggcccaagtaaaagagtgacacagtgtcgtggaacaaagtgggcacaanaaggagggcacataagcacgtaaagagactgggccactgatattaacaacgtatgggatgggggacgaaaatgtttctgatggcaactatgtgcgagggacacctcatattagtgggtggaacaattattgggagaactctttacaagaatatgaggacttaggggcactataacgtgaaggggtataggggtatacacagcagacatagtatagaggtgacactgcttcagatattaatcnn

SEQ ID NO: 320223 - DNA, 4033 bp, Homo sapiens
catgttgtcgtgacttttgagtacgccaggcttaggctgcagttatttgaactcgagaggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtatgtgctctgctcagagaactctttctcttgtcccgggagcctctttgaaagtgacgttaatgcagaggacacttcactgatttcttcctcatggaccgtgtgccttaagagaggcattctctctcaagccaagggatcttgtccatcctgtttttccttaatgagagacattgactacctcagaggaccctgagacccagccacgggccctgtgcagacctgcccagccctggtgaacagggcttctgccacggccttcacagtcaaggtggccccactgcccccttcagacgccacagggagccctggagaaggtacccttggtacctgcttttgcaagtaaatctaagagcatgtcagtccccaggagtgcccgggtgcagcctgccactttccgtaaggggttctcttgccgcggactagtttctcgtttgcttggtagctggtgggcctcagggatctcccgagaggcctcacctatcccagggccagcctgctccctgaggtgagtgccctttgagcagaggctgctggcgcatgcgtgtgcgtgtctgtgcatctgtccgtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320224 - DNA, 3782 bp, Homo sapiens
catgttgtcgtgacttttgagtacgccaggcttaggctgcagttatttgaactcgagaggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtatgtgctctgctcagagaactctttctcttgtcccgggagcctctttgaaagtgacgttaatgcagaggacacttcactgatttcttcctcatggaccgtgtgccttaagagaggcattctctctcaagccaagggatcttgtccatcctgtttttccttaatgagagacattgactacctcagaggaccctgagacccagccacgggccctgtgcagacctgcccagccctggtgaacagggcttctgccacggccttcacagtcaaggtggccccactgcccccttcagacgccacagggagccctggagaaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320225 - DNA, 3411 bp, Homo sapiens
catgttgtcgtgacttttgagtacgccaggcttaggctgcagttatttgaactcgagaggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaagttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320226 - DNA, 3413 bp, Homo sapiens
catgttgtcgtgacttttgagtacgccaggcttaggctgcagttatttgaactcgagaggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagaatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320227 - DNA, 3206 bp, Homo sapiens
catgttgtcgtgacttttgagtacgccaggcttaggctgcagttatttgaactcgagaggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaagctttggcaacaggcaggcagctttatcagcagcttggcaacattctgtaaaagcagctttataccttttagcaaagaaaaggagttccggggcataaaagtaaggatgtcttctggcaatttcatataagtattttttcaaaaatgtctcttcattgtcatgaaaagcagtgcacatcacatcaacctctggtctcaccaatcgggggag

SEQ ID NO: 320228 - DNA, 3069 bp, Homo sapiens
ggcacgaggcgcgcacgcagccagcgagcggccggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcagaaagaagcttccggttctgaggtcctggaggtgccatttccctctctgttgaagcaaaggccggggcagacctcctagtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcccgggtcacagtgaagcatctcgaagagattgtagagaagctaaaaggagaacttgaaagttcggaccaggtatgtgctctgctcagagaactctttctcttgtcccgggagcctctttgaaagtgacgttaatgcagaggacacttcactgatttcttcctcatggaccgtgtgccttaagagaggcattctctctcaagccaagggatcttgtccatcctgtttttccttaatgagagacattgactacctcagaggaccctgagacccagccacgggccctgtgcagacctgcccagccctggtgaacagggcttctgccacggccttcacagtcaaggtggccccactgcccccttcagacgccacagggagccctggagaaggtacccttggtacctgcttttgcaagtaaatctaagagcatgtcagtccccaggagtgcccgggtgcagcctgccactttccgtaaggggttctcttgccgcggactagtttctcgtttgcttggtagctggtgggcctcagggatctcccgagaggcctcacctatcccagggccagcctgctccctgaggtgagtgccctttgagcagaggctgctggcgcatgcgtgtgcgtgtctgtgcatctgtccgtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320229 - DNA, 2429 bp, Homo sapiens
ggcacgaggcgcgcacgcagccagcgagcggccggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcagaaagaagcttccggttctgaggtcctggaggtgccatttccctctctgttgaagcaaaggccggggcagacctcctagtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagagtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320230 - DNA, 1346 bp, Homo sapiens
tgcctcacctcggtttccccccaggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320231 - DNA, 2779 bp, Homo sapiens
catgttgtcgtgacttttgagtacgccaggcttaggctgcagttatttgaactcgagaggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcaggttagggcggtgagctggtccccagacacatcactaatcccagaagagtgcaggccctgctgcctccgttcggactaaaccccgcactggctgctccagcctccgctgcttccccaccccaccctgctttgccccatttggatcatccaggttcggagaaagccacagagcatggaacagaaa

SEQ ID NO: 320232 - DNA, 3857 bp, Homo sapiens
catgttgtcgtgacttttgagtacgccaggcttaggctgcagttatttgaactcgagaggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtatgtgctctgctcagagaactctttctcttgtcccgggagcctctttgaaagtgacgttaatgcagaggacacttcactgatttcttcctcatggaccgtgtgccttaagagaggcattctctctcaagccaagggatcttgtccatcctgtttttccttaatgagagacattgactacctcagaggaccctgagacccagccacgggccctgtgcagacctgcccagccctggtgaacagggcttctgccacggccttcacagtcaaggtggccccactgcccccttcagacgccacagggagccctggagaaggtacccttggtacctgcttttgcaagtaaatctaagagcatgtcagtccccaggagtgcccgggtgcagcctgccactttccgtaaggggttctcttgccgcggactagtttctcgtttgcttggtagctggtgggcctcagggatctcccgagaggcctcacctatcccagggccagcctgctccctgaggtgagtgccctttgagcagaggctgctggcgcatgcgtgtgcgtgtctgtgcatctgtccgtgagggagcacacgtcgcatttggaggcagagctggaaaagcacatggcggccgccagcgccgagtgccagaactacgccaaggaggtggcaggggtgagtctgccccccaaggagtgcagcccctgcccagcagatctgcggtcctccctgagctgcttctcctcagccctgtgggagcagctctcggtgacataagccttgaagtccgagtcctcaggcgtttgcccgaagcctcacaggcccctcgttgggctgtcaggcctgaggtgtctctcagggcaggtttcaggaggcgtttgacgttctaggttatccctccgcaaggggattctctgcctggcttgctgatgtcatatctggtggggagtggatttagatctgacactttttctgctcttcagaagcagaagcacaagcccagtatcccaattctggtttaatctcaaacttttgggccaggcacagcggctcatgcctgtaatcccagcactttgaaaggctgaggtggattgctcgaggccagaaatttgagaccggcctgggcaacatagcaagaccgcatctgtaccaaaaaaaaaaaaaaaagccaggcacactggtgggcacctccgttcccagctgcttaggaggctgatgcaggaggattgcctgagcccaagagttcaagaccagcgtggatgacagattgagaccatctctgaaaaaaaaaatcatctccaacttttggcccttttttgccagagataatcagtaaacatttgtgaaggcctgaaagaggtacgcagtgaacaccattcttcctaagtcctcaaaaaagaaatcgtagctgtaggaagcctggcgagccctgtgccggcccgatgctgtgaccctcctcagggttttggttaagtggatgtgttaggttttatgtttcggcgctaactcacggggactggttttctccttttctctccttttttcccatcacccgcctct

SEQ ID NO: 320233 - DNA, 888 bp, Homo sapiens
cgggacagtacggacgtggagctagaactggcagagaaccatgctaggtgctggcaaggaccatcctcccactgccagccaatggggagcctcacttcccggctgggggccgtgagggcacacagggtccttccaggcagcccattagcactccacactgagggacacaggctgttggctccattttagggaaaatcaacttctcccaaatgtgagggggatgtgtgggggctgaacagcaaattctagcttctctgcagctatccagtagcatgagaaaatcaatctagtcctctcttcgggaggactaagggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320234 - DNA, 1415 bp, Homo sapiens
ggcacgaggcgcgcacgcagccagcgagcggccggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcagaaagaagcttccggttctgaggtcctggaggtgccatttccctctctgttgaagcaaaggccggggcagacctcctagtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggaggtgccgatggtggtggtgcccccagtgggtgccaagggcaacacaccagccactggcactactcagggcaaaaaggcggaggggactcagaatcaaagcaaaaaggctgaaggagccccaaaccagggcagaaaggcagagggaaccccaaaccagggcaaaaagacagagggaaccccaaaccaagggaaaaaggcagagggaaccccaaaccaaggcaaaaaggcagaaggaaccccaaaccaaggcaaaaaggcggagggggcccagaaccagggtaaaaaggtagatacaaccccaaaccaggggaaaaaggtggagggggccccaacccagggcagaaaggccgagggggctcagaaccaggccaaaaaggtagaaggggcccagaaccagggcaaaaaggcagagggggcccagaatcagggcaaaaagggagagggggcccagaaccagggcaagaaggccgagggggcccagaatcagggcaagaaggccgagggggcccagaatcagggcaagaagccgaggggcccagaatcagggcaagaagccgaggggcccagaatcaggcagaaggctgagggg

SEQ ID NO: 320235 - DNA, 657 bp, Homo sapiens
catgttgtcgtgacttttgagtacgccaggcttaggctgcagttatttgaactcgagaggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaatcagggcaaaaagggagagggggcccagaaccagggcaagaaggccgagggggcccagaatcagggcaagaaggctgtggggccgactggaggccacagcccctcacccctagacgttgccaaccagaactgacgtgtgacctcctgggtgttgatgccattaaaaccaacgttggtgcccggtg

SEQ ID NO: 320236 - DNA, 441 bp, Homo sapiens
gcagaaatacagatgtggcccagagcccagaggcaccaaagcaagaggctcctgccaagaagaagtctggttcaaagaaaaaaggtgagcctggtaagtaactgatttctttatgaacttagaaggaaaggctgtctttaaatgacttatggattctctcggggagtgccacctgtatcagtcagctattgtcataataaggctgcgtaacaaacattcaaaaaaaaattcagtggccttcaacagcagtcatttattgttgctcatgcttctggaggttggcagatgtgagctttctcggttggtggctctgcctcaatctggttttaactgggttggtgactctttgctacaggttgagctcaggtcagttccatgtgtggtccttctggcgccctccagggcagaggcccttcatagttacaacagaggcacaaaagg

SEQ ID NO: 320237 - DNA, 549 bp, Homo sapiens
  misc_feature (12)..(12): n is a, c, g, or t
  misc_feature (42)..(42): n is a, c, g, or t
  misc_feature (50)..(50): n is a, c, g, or t
  misc_feature (71)..(71): n is a, c, g, or t
  misc_feature (114)..(114): n is a, c, g, or t
  misc_feature (118)..(118): n is a, c, g, or t
  misc_feature (182)..(182): n is a, c, g, or t
  misc_feature (330)..(330): n is a, c, g, or t
  misc_feature (355)..(355): n is a, c, g, or t
cccttccaaagnagaagcttctcccaaagttccagggttggnaggttcancctcccattatctttacattntgtgtcatgccaaggaaaaaaaacatgcccctattaccttganaagntcccgtaggtcccttactattcttaaactctcacaaagtgggtgtgacccccatccctgtgcangctcctttgttaactttggccactcattcttcacattcttgaaagcgccagaacccaccaataaatggccgggtcctctgcttaaccagattgtttcctgcaaagcgacatgtcctccaagcttcaatctcacatgccatgttggatntggcctaattccacctccaatacanaggaggcatggagatgtctgggttaatgtgccaggtcataacggcacgagagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320238 - DNA, 3465 bp, Homo sapiens
catgttgtcgtgacttttgagtacgccaggcttaggctgcagttatttgaactcgagaggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320239 - DNA, 3672 bp, Homo sapiens
actagtccacggttggctggaggggagccagaagcctggaggatgcaggcattcttactgctgcaggactctgtgggcgagttgggctggcagtcagatttctgggggctctgtggactaaccagaccaaagaagcttccggttctgaggtcctggaggtgccatttccctctctgttgaagcaaaggccggggcagacctcctagtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320240 - DNA, 2640 bp, Homo sapiens
gggaacacagcggatgtcgccgatatctacatccgagtggatctctatgaacgcgtagataggcctctattacacaggccataaccccagcccggcgaggctcaagagatgatcccagcacgctggtggccctcctgatgcagcgacatcacgggtgagcatgtgcggcatgcatcgccatgcgtaccgggaagcatccctgagggatcgttactcgatgtgcatggctgaactccatattcttcatgagcagctgtgtgaatggaccgctagcctagcgtgacgtctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320241 - DNA, 3422 bp, Homo sapiens
catgttgtcgtgacttttgagtacgccaggcttaggctgcagttatttgaactcgagaggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320242 - DNA, 1754 bp, Homo sapiens
ctcgaattcgacggtttctccttggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320243 - DNA, 3411 bp, Homo sapiens
catgttgtcgtgacttttgagtacgccaggcttaggctgcagttatttgaactcgagaggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320244 - DNA, 1997 bp, Homo sapiens
ggaactatttcttcattccagaagggcagagctctggccatagtatccttcagactctcacaggagggtagctgatcttctgtgaggtctgcatacctgcgaacctatgatcataggttcgcaggctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtatgtgctctgctcagagaactctttctcttgtcccgggagcctctttgaaagtgacgttaatgcagaggacacttcactgatttcttcctcatggaccgtgtgccttaagagaggcattctctctcaagccaagggatcttgtccatcctgtttttccttaatgagagacattgactacctcagaggaccctgagacccagccacgggccctgtgcagacctgcccagccctggtgaacagggcttctgccacggccttcacagtcaaggtggccccactgcccccttcagacgccacagggagccctggagaaggtacccttggtacctgcttttgcaagtaaatctaagagcatgtcagtccccaggagtgcccgggtgcagcctgccactttccgtaaggggttctcttgccgcggactagtttctcgtttgcttggtagctggtgggcctcagggatctcccgagaggcctcacctatcccagggccagcctgctccctgaggtgagtgccctttgagcagaggctgctggcgcatgcgtgtgcgtgtctgtgcatctgtccgtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320245 - DNA, 3343 bp, Homo sapiens
catgttgtcgtgacttttgagtacgccaggcttaggctgcagttatttgaactcgagaggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcaggggtgagtctgccccccaaggagtgcagcccctgcccagcagatctgcggtcctccctgagctgcttctcctcagccctgtgggagcagctctcggtgacataagccttgaagtccgagtcctcaggcgtttgcccgaagcctcacaggcccctcgttgggctgtcaggcctgaggtgtctctcagggcaggtttcaaaaaggcagcctcccagccaggacaggggcagagccaggcagccctgccccgagggaggcgtttgacgttctaggttatccctccgcaaggggattctctgcctggcttgctgatgtcatatctggtggggagtggatttagatctgacactttttctgctcttcagaagcagaagcacaagcccagtatcccaattctggtttaatctcaaacttttgggccaggcacagcggctcatgcctgtaatcccagcactttgaaaggctgaggtggattgctcgaggccagaaatttgagaccggcctgggcaacatagcaagaccgcatctgtaccaaaaaaaaaaaaaaaagccaggcacactggtgggcacctccgttcccagctgcttaggaggctgatgcaggaggattgcctgagcccaagagttcaagaccagcgtggatgacagattgagaccatctctgaaaaaaaaaatcatctccaacttttggcccttttttgccagagataatcagtaaacatttgtgaaggcctgaaagaggtacgcagtgaacaccattcttcctaagtcctcaaaaaagaaatcgtagctgtaggaagcctggcgagccctgtgccggcccgatgctgtgaccctcctcagggttttggttaagtggatgtgttaggttttatgtttcggcgctaactcacggggactggttttctccttttctctccttttttcccatcacccgcctct

SEQ ID NO: 320246 - DNA, 2541 bp, Homo sapiens
catgttgtcgtgacttttgagtacgccaggcttaggctgcagttatttgaactcgagaggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagtacttgagagaaatgaagagggagcagcataaggatcctctaga

SEQ ID NO: 320247 - DNA, 1101 bp, Homo sapiens
gtcctgtgagtctcgttaaaggcccctgaggttgcagaggccccatcagctgctcctgagccacaccgaagtctgtaccaggggctgaggtgccctctccccaacgaggggagcgttggggcagggaaaggggaagctagaagcagctagagagcggtgcctgtgctggatccctgggcccctggagggttcctcaccgggctgccgggttatgtttgcggtgtttgcacagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 320248 - DNA, 574 bp, Homo sapiens
  misc_feature (429)..(429): n is a, c, g, or t
  misc_feature (431)..(431): n is a, c, g, or t
catgttgtcgtgacttttgagtacgccaggcttaggctgcagttatttgaactcgagaggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagtaaagacagtgaggcccaggcctagggggcaacgagtttctcaacaaccatgttacgccacttccccaccccnancaggcgtccttaagactaacctactcccttttctcactctcatccccaccacagatccctggattgctgggaatggaagccaggtggggtcatggcacaagttctgtaatcttcaaaataaaactttttttttgtaaaaaaaa

SEQ ID NO: 320249 - DNA, 399 bp, Homo sapiens
ggtgtagacagtgtggcggccaccccccggttccattcggattcctttgctctgtgggccatgcccatcaggggtcacctcactcccagggagggctcccctccggttgggcttggagcagagcacattgggtctcattagcccagaggcttggtggccttggtttggctcaggttggcggcgggggtggccagacataggtcacagttaccaagccaggtcccctgaagggactttggctgttgagagcagctacggtcctccgagggggtccctgcaggagtgagcatggtgggtgtgcgactggctgtgcatttgcaaacacaccccttcctgttccaggtcaggcagcagttgagtgaaatgaagagccacgtagaggatggtgacatagctggg

SEQ ID NO: 320250 - DNA, 622 bp, Homo sapiens
ccttctccagccaccactcagatctttctgcttctccttacagcaaaactcctccaaagttatcccttcttctcttcccttctgaacttacttcaatcacacttcaaatatcgtaacatcatctacaccagaggtcagtgacctgtggcccatgaaccaatccagcccactatgtgtttctgtaaataaggttttattcaaggataaccatgctcattccgtaggtactacctatgactagtgctacagcagcagaattgagtatttgcagcaaagatcagatggcctgcaaagcctaaaatatttactctctggcccgttacagaaaaagtttcctggctacttatctaaaccactttattcagggccaccaatgaacttcatgttgcccaatcaaatgttgattctcaggtctcatcttactctgttgatcttcccattagacatagttcatcatatctttcttcctgaaacgcttgcttccttgaactctggtacacctccacattttcatggtcatcctaccccatatagcatttgtcctcagtctgttttgctggatccctcttcatctttctggtctttaaaaattgggggtatttggactcagtttttgagtctc

SEQ ID NO: 320251 - DNA, 684 bp, Homo sapiens
ggccgccgagcgccgatcggctcgatgagcggaggcgctgctgcggcgctgcggccgacgccgggtccgcaccaactgtctccccctcccagcttcttacctcggcttcctactccttcccccgcccgcccagcaccgccagcccgggagagctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctaaggggaccatctggaccaagatttggacctagaaatgataaaattaagcatgttcagaatcaagtggatgaagttattgatgtcatgcaagaaaatattacaaaggtaattgagagaggggagagactagatgaactacaggacaaatcagaaagcttatcggataatgcaacagcttttagcaacagatccaaacaacttcgaaggcaaatgtggtggcgtggatgcaaaaataaaagcccatcatgggctttgggttgcctgcttatccctttttgcttagtggatttattcaatttctttattagtccatggaaaaataacccggcccccttggaaatt

SEQ ID NO: 320252 - DNA, 1655 bp, Homo sapiens
ggccgccgagcgccgatcggctcgatgagcggaggcgctgctgcggcgctgcggccgacgccgggtccgcaccaactgtctccccctcccagcttcttacctcggcttcctactccttcccccgcccgcccagcaccgccagcccgggagagctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctaaggggaccatctggaccaagatttggacctagaaatgataaaattaagcatgttcagaatcaagtggatgaagttattgatgtcatgcaagaaaatattacaaagaaagcttatcggataatgcaacagcttttagcaacagatccaaacaacttcgaaggcaaatgtggtggcgtggatgcaaaataaaagccatcatggctttggttgctgctatccttttgctagtgattatcattcttatagtcatgaaataccgtacttgatttgatgacagagatcttcattaaacaagatctgggacagtaataaaagattgctgcataatttaaatgaaacctatgtgtatataactttcaaaacttctttttcaagaaactaagaggcaagtatcacttcaaattggaacgttgagaatgtccaattatcttctccctttctaacaaaatgttcttttaataattatgtttaaggcaaagagaactagcctctatttttccatatttcaaggatctaatttgaaactagatacttgccagttcattatttgtgtatataaacactgattataatatttcatattaatattttaatggcataaggacttgcattattgcattagggagcgggtcatgctgggggtcaggaagcctgtgtagagtaccaaattatatgctgaaagagatgcataaccattctgtcaatatttgcagaaatatagttcctttcatattacagttgttttgcaagcaatttccacatttataggtgtaacaaaagctaaatgttgtaaatgttgttgccctcaggtataactaaaaacattccagtaaatatatttttgactgtgtaagagaatgtgtagtaatttttttggcattggattatggaaatggaaatttttaaacagtgtgaaaaaacatggtatggcatcataaaactggagataataaagttattgaagagtgtcattggagtatttgaaaatgaccaatatatagctgccagtcatggtccagtctgttttctgttaaactccaataaagagagaccagtcagtcctaatgtgagtaaatgaaatttacaggtaacttacttactccttaattttattttagttaatagcctctaacttccaactatctcatttaccaaaagtacaaaaagtagcaaaaccatctattaatactttgaattttatatctttgcatttcctgttcatccttgaggagatgtatgttgcacaatcaaattttgcatcagccaacagtaatgagtagtagaaagtcaggaacctatgtgtatatatatat

SEQ ID NO: 320253 - DNA, 1613 bp, Homo sapiens
ggccgccgagcgccgatcggctcgatgagcggaggcgctgctgcggcgctgcggccgacgccgggtccgcaccaactgtctccccctcccagcttcttacctcggcttcctactccttcccccgcccgcccagcaccgccagcccgggagagctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggtgttcagaatcaagtggatgaagttattgatgtcatgcaagaaaatattacaaagataaaagaatcctgttatgtcgtttaatccttctctccatcctctatgtgatatagaaagcttatcggataatgcaacagcttttagcaacagatccaaacaacttcgaaggcaaatgtggtggcgtggatgcaaaataaaagccatcatggctttggttgctgctatccttttgctagtgattatcattcttatagtcatgaaataccgtacttgatttgatgacagagatcttcattaaacaagatctgggacagtaataaaagattgctgcataatttaaatgaaacctatgtgtatataactttcaaaacttctttttcaagaaactaagaggcaagtatcacttcaaattggaacgttgagaatgtccaattatcttctccctttctaacaaaatgttcttttaataattatgtttaaggcaaagagaactagcctctatttttccatatttcaaggatctaatttgaaactagatacttgccagttcattatttgtgtatataaacactgattataatatttcatattaatattttaatggcataaggacttgcattattgcattagggagcgggtcatgctgggggtcaggaagcctgtgtagagtaccaaattatatgctgaaagagatgcataaccattctgtcaatatttgcagaaatatagttcctttcatattacagttgttttgcaagcaatttccacatttataggtgtaacaaaagctaaatgttgtaaatgttgttgccctcaggtataactaaaaacattccagtaaatatatttttgactgtgtaagagaatgtgtagtaatttttttggcattggattatggaaatggaaatttttaaacagtgtgaaaaaacatggtatggcatcataaaactggagataataaagttattgaagagtgtcattggagtatttgaaaatgaccaatatatagctgccagtcatggtccagtctgttttctgttaaactccaataaagagagaccagtcagtcctaatgtgagtaaatgaaatttacaggtaacttacttactccttaattttattttagttaatagcctctaacttccaactatctcatttaccaaaagtacaaaaagtagcaaaaccatctattaatactttgaattttatatctttgcatttcctgttcatccttgaggagatgtatgttgcacaatcaaattttgcatcagccaacagtaatgagtagtagaaagtcaggaacctatgtgtatatatatat

SEQ ID NO: 320254 - DNA, 533 bp, Homo sapiens
ggccgccgagcgccgatcggctcgatgagcggaggcgctgctgcggcgctgcggccgacgccgggtccgcaccaactgtctccccctcccagcttcttacctcggcttcctactccttcccccgcccgcccagcaccgccagcccgggagagctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctaaggggaccatctggaccaagatttggacctagaaatgataaaattaagcatgttcagaatcaagtgcgacaaggccagtggggaggggagatacaaagaacagccgtatgctctacataccaagattttatttgcatcattgagtcgacccttcaaggcagttggaagttcacctatattcggttggataa

SEQ ID NO: 320255 - DNA, 323 bp, Homo sapiens
cctgcagttcctcactcccataccagcttcagtgacctttctaccttttttagtcagttataggattctataattatgagcattttctttgcaaagtctataaatgttgtcccacatcttttagcttccagtgaaggatatgtaattacttttccctctttatggacacctggagttaagaaatttcactagtataggacttatttcattactcctctgtgacattttataagccctctgaatctgaaaactcaagtctttttctttttttgacagagaaatcttttggaagatgattcagatgaagaagaggacttttttct

SEQ ID NO: 320256 - DNA, 1701 bp, Homo sapiens
ggccgccgagcgccgatcggctcgatgagcggaggcgctgctgcggcgctgcggccgacgccgggtccgcaccaactgtctccccctcccagcttcttacctcggcttcctactccttcccccgcccgcccagcaccgccagcccgggagagctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctaaggggaccatctggaccaagatttggacctagaaatgataaaattaagcatgttcagaatcaagtggatgaagttattgatgtcatgcaagaaaatattacaaaggtaattgagagaggggagagactagatgaactacaggacaaatcagaaagcttatcggataatgcaacagcttttagcaacagatccaaacaacttcgaaggcaaatgtggtggcgtggatgcaaaataaaagccatcatggctttggttgctgctatccttttgctagtgattatcattcttatagtcatgaaataccgtacttgatttgatgacagagatcttcattaaacaagatctgggacagtaataaaagattgctgcataatttaaatgaaacctatgtgtatataactttcaaaacttctttttcaagaaactaagaggcaagtatcacttcaaattggaacgttgagaatgtccaattatcttctccctttctaacaaaatgttcttttaataattatgtttaaggcaaagagaactagcctctatttttccatatttcaaggatctaatttgaaactagatacttgccagttcattatttgtgtatataaacactgattataatatttcatattaatattttaatggcataaggacttgcattattgcattagggagcgggtcatgctgggggtcaggaagcctgtgtagagtaccaaattatatgctgaaagagatgcataaccattctgtcaatatttgcagaaatatagttcctttcatattacagttgttttgcaagcaatttccacatttataggtgtaacaaaagctaaatgttgtaaatgttgttgccctcaggtataactaaaaacattccagtaaatatatttttgactgtgtaagagaatgtgtagtaatttttttggcattggattatggaaatggaaatttttaaacagtgtgaaaaaacatggtatggcatcataaaactggagataataaagttattgaagagtgtcattggagtatttgaaaatgaccaatatatagctgccagtcatggtccagtctgttttctgttaaactccaataaagagagaccagtcagtcctaatgtgagtaaatgaaatttacaggtaacttacttactccttaattttattttagttaatagcctctaacttccaactatctcatttaccaaaagtacaaaaagtagcaaaaccatctattaatactttgaattttatatctttgcatttcctgttcatccttgaggagatgtatgttgcacaatcaaattttgcatcagccaacagtaatgagtagtagaaagtcaggaacctatgtgtatatatatat

SEQ ID NO: 320257 - DNA, 1239 bp, Homo sapiens
ggccgccgagcgccgatcggctcgatgagcggaggcgctgctgcggcgctgcggccgacgccgggtccgcaccaactgtctccccctcccagcttcttacctcggcttcctactccttcccccgcccgcccagcaccgccagcccgggagagctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctaaggggaccatctggaccaagatttggacctagaaatgataaaattaagcatgttcagaatcaagtggatgaagttattgatgtcatgcaagaaaatattacaaaggtaattgagagaggggagagactagatgaactacaggacaaatcagaaagcttatcggataatgcaacagcttttagcaacagatccaaacaacttcgaaggcaaatgtggtggcgtggatgcaaaataaaagccatcatggctttggttgctgctatccttttgctagtgattatcattcttatagtcatgaaataccgtacttgatttgatgacagagatcttcattaaacaagatctgggacagtaataaaagattgctgcataatttaaatgaaacctatgtgtatataactttcaaaacttctttttcaagaaactaagaggcaagtatcacttcaaattggaacgttgagaatgtccaattatcttctccctttctaacaaaatgttcttttaataattatgtttaaggcaaagagaactagcctctatttttccatatttcaaggatctaatttgaaactagatacttgccagttcattatttgtgtatataaacactgattataatatttcatattaatattttaatggcataaggacttgcattattgcattagggagcgggtcatgctgggggtcaggaagcctgtgtagagtaccaaattatatgctgaaagagatgcataaccattctgtcaatatttgcagaaatatagttcctttcatattacagttgttttgcaagcaatttccacatttataggtgtaacaaaagctaaatgttgtaaatgttgttgccctcaggtataactaaaaacattccagtaaatatatttttgactgtgt

SEQ ID NO: 320258 - DNA, 768 bp, Homo sapiens
ggccgccgagcgccgatcggctcgatgagcggaggcgctgctgcggcgctgcggccgacgccgggtccgcaccaactgtctccccctcccagcttcttacctcggcttcctactccttcccccgcccgcccagcaccgccagcccgggagagctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctaccgcagttgaccatgggtaactgaaactgtggaaagcaaaaccatgggtgagagagagcttactgtaccgtgtacctgtgacatcatcaccaaaatcaaataatgaaccatctgtcgccctgcaagtttcctcataacccttgataatccattgctctcccagtccctaggcaaccagtgctctgctttctgtcactgtagttgtatttctaaaattttttataaatgaaatcatgcagtatgccccctttttaaaacctggctttattcagcatggtttttgagattcatccatgtgttaatagttggggtttttaattttctgagtagtattccattgtatgatgctgcagttcgttatgcattcacttatgtggtggatttttgggttgtttctactttttggcttttacatataaagctgtt

SEQ ID NO: 320259 - DNA, 1123 bp, Homo sapiens
ggccgccgagcgccgatcggctcgatgagcggaggcgctgctgcggcgctgcggccgacgccgggtccgcaccaactgtctccccctcccagcttcttacctcggcttcctactccttcccccgcccgcccagcaccgccagcccgggagagctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctatatgcagtagtctcccttatacgtgagagatgccttccaagatcccccagtggatatgtgaaaacacagagagtagcacgttgtgacataacgttaggtactattgacctctgatgatatgtcagaaggagaatcatctatttcaggtgaccttggatcatgaagccaagaagatgttgataactaaagggctgggtagtatatacaatgtggatatgcaggacaaaggggtgattcacatttcaggtgggacaaagcggggcaatgtgaggtttcatcatgctactcagaatggtgcacaatttaaaacttatgaattgtttatttctggaattttccatttaatattttcagaccgcagttgaccatgggtaactgaaactgtggaaagcaaaaccatgggtgagagagagcttactgtaccgtgtacctgtgacatcatcaccaaaatcaaataatgaaccatctgtcgccctgcaagtttcctcataacccttgataatccattgctctcccagtccctaggcaaccagtgctctgctttctgtcactgtagttgtatttctaaaattttttataaatgaaatcatgcagtatgccccctttttaaaacctggctttattcagcatggtttttgagattcatccatgtgttaatagttggggtttttaattttctgagtagtattccattgtatgatgctgcagttcgttatgcattcacttatgtggtggatttttgggttgtttctactttttggcttttacatataaagctgtt

SEQ ID NO: 320260 - DNA, 438 bp, Homo sapiens
attactgtccccatggctggagagagttgattcatcatctgcttctcactggagagggtcgggggtacctctctgccagggctgaccaggcttctcctgagtcacctggaaccaccctcccatgctgacccagcttcctttcttgcagcatatggggtgaagaaaaacatgccccagagtcctgcggctgtgaacactggcgtttccacctccgccggtgagtgctgctcccagctgccagggatcaggctggtgcacagggaggattactctgcagtaatcctgcctgtgtatccttccaatacacatggtatactggaagaggaaataggacccatgagtggtcttaggcctgcaaacgcaacttgccccaaaggcctcttggatgtttccatgagtgaataaaggtgaacattcccatgaatgttcctatcagaa

SEQ ID NO: 320261 - DNA, 2081 bp, Homo sapiens
aacatttttgaaagatcactcagctttaacacaccttggctgggtctggataaaaaaaaagtgagcactgcaaatttctagaagaaaacatcaggagaagaaagagagagggggatttattcaaagttgtttccaattccttcaaaacctcaaaccaggtggctatggtatggatgtaaccaagaaaaacaaacgagatggaactgaagtcactgagagaattgtcactgaaacagtaaccacaagacttacatccttaccaccaaaaggcgggaccagcaatggctatgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgttacccgccatgcgtatgaagggagctccagtggcaactcttctccggagtaccctcggaaggaatttgcatcttcttcaaccagaggacggagtcaaacacgagagagtgaaattcgagttcgactgcagagtgcgtccccatccacccgatggacagaattggatgatgttaagcgtttgctcaaggggagtcgatcggcaagtgtgagccccacccggaattcctccaacacactccccatccccaagaaaggcactgtggagaccaaaattgtgacagcgagctcccagtcggtgtcaggcacctacgatgcaatgatcctggatgccaaccttccctcccatgtgtggtcctccaccctgcccgcggggtcctccatggggacctatcacaacaacatgacaacccagagctcatccctcctcaacaccaatgcctactctgcgggatcagtcttcggagttccaaacaacatggcgtcctgctcacccactttgcaccctggactcagcacatcctcctcagtgtttggcatgcagaacaatctggcccccagcttgaccaccctgtcccatggcaccaccaccacttccacagcatatggggtgaagaaaaacatgccccagagtcctgcggctgtgaacactggcgtttccacctccgccgcctgcaccacaagtgtgcagagcgatgaccttttgcacaaggactgcaagttcctgatcctagagaaagacaacacacctgccaagaaggagatggagctgctcatcatgaccaaggacagcgggaaggtctttacagcctcccctgccagcatcgctgcaacttctttttcagaagacaccctaaaaaaagaaaagcaagctgcctacaatgctgactcaggcctaaaagccgaagctaatggagacctgaagactgtgtccacaaagggcaagaccaccactgcagatatccacagctacggcagcagtggtggtggtggcagtggaggaggtggcggtgttggtggcgctggcggcggcccttggggaccagcgccagcctggtgcccctgcggctcctgctgcagctggtggaagtggctgctgggcctgctgctcacctggctgctactcctggggctgctcttcggcctcattgctctggcggaggaggtgaggaagctgaagcgcgtgtggatgagctggagaggatcaggaggagcatactgccctatggggacagcatggatagaatagaaaaggaccgcctccagggcatggcacccgcggcgggagcagacctggacaaaattgggctgcacagtgacagccaggaggagctctggatgttcgtgaggaagaagctaatgatggaacaggaaaatggaaatctccgaggaagccctggccctaaaggtattgccatggattgaaccttgtctctgattcatttcctgcagttggaagtgagttttctgggtagattagaagcctttttctttgttctaaatggaaggatgaagagctgaatgatcttatggtatctgttgggaggtatctgttggttttagagtcagaatatcttagataaggcagcatctaagagaagccc

SEQ ID NO: 320262 - DNA, 1066 bp, Homo sapiens
tattcacagagggatgttccgctggcgattggtggggtgcaaatgcaccacagcgatttcacagcatatggggtgaagaaaaacatgccccagagtcctgcggctgtgaacactggcgtttccacctccgccgcctgcaccacaagtgtgcagagcgatgaccttttgcacaaggactgcaagttcctgatcctagagaaagacaacacacctgccaagaaggagatggagctgctcatcatgaccaaggacagcgggaaggtctttacagcctcccctgccagcatcgctgcaacttctttttcagaagacaccctaaaaaaagaaaagcaagctgcctacaatgctgactcaggcctaaaagccgaagctaatggagacctgaagactgtgtccacaaagggcaagaccaccactgcagatatccacagctacggcagcagtggtggtggtggcagtggaggaggtggcggtgttggtggcgctggcggcggcccttggggaccagcgccagcctggtgcccctgcggctcctgctgcagctggtggaagtggctgctgggcctgctgctcacctggctgctactcctggggctgctcttcggcctcattgctctggcggaggaggtgaggaagctgaagcgcgtgtggatgagctggagaggatcaggaggagcatactgccctatggggacagcatggatagaatagaaaaggaccgcctccagggcatggcacccgcggcgggagcagacctggacaaaattgggctgcacagtgacagccaggaggagctctggatgttcgtgaggaagaagctaatgatggaacaggaaaatggaaatctccgaggaagccctggccctaaaggtattgccatggattgaaccttgtctctgattcatttcctgcagttggaagtgagttttctgggtagattagaagcctttttctttgttctaaatggaaggatgaagagctgaatgatcttatggtatctgttgggaggtatctgttggttttagagtcagaatatcttagataaggcagcatctaagagaagccc

SEQ ID NO: 320263 - DNA, 460 bp, Homo sapiens
catcgctcagccttttctactatttaaaatttcctaatatgcaacttgctatattccacccaggagacttttcttttaaatcaggtggaatactcactctagatatttgtataaaacaaaacaaaacaaaacaaaacaaaacaaaacaaaaaaccaacgaaactggagcatggcagcttgcatcttataatgtaggtgggaaaggaaccccaaactaagaaggtcctggtgaaaaaccagggaagccttccacagggtgggggaccaggggatcctctggcctgactccaccctgaaattatcacctgcttttgttcctggcagaaggcgggaccagcaatggctatgctaaaacagcctctcttggtggagggagccggctggagaaacaaagcctgactcatggcagcagcggctacataaactcaagtgagtgcccactagtgcaagaggtcaggga

SEQ ID NO: 320264 - DNA, 2150 bp, Homo sapiens
aacatttttgaaagatcactcagctttaacacaccttggctgggtctggataaaaaaaaagtgagcactgcaaatttctagaagaaaacatcaggagaagaaagagagagggggatttattcaaagttgtttccaattccttcaaaacctcaaaccaggtggctatggtatggatgtaaccaagaaaaacaaacgagatggaactgaagtcactgagagaattgtcactgaaacagtaaccacaagacttacatccttaccaccaaaaggcgggaccagcaatggctatgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgttacccgccatgcgtatgaagggagctccagtggcaactcttctccggagtaccctcggaaggaatttgcatattaaggggactatcagccacattaacttgctgtcataagcctttgctcgtggcactatagaaatgcatcttcttcaaccagaggacggagtcaaacacgagagagtgaaattcgagttcgactgcagagtgcgtccccatccacccgatggacagaattggatgatgttaagcgtttgctcaaggggagtcgatcggcaagtgtgagccccacccggaattcctccaacacactccccatccccaagaaaggcactgtggagaccaaaattgtgacagcgagctcccagtcggtgtcaggcacctacgatgcaatgatcctggatgccaaccttccctcccatgtgtggtcctccaccctgcccgcggggtcctccatggggacctatcacaacaacatgacaacccagagctcatccctcctcaacaccaatgcctactctgcgggatcagtcttcggagttccaaacaacatggcgtcctgctcacccactttgcaccctggactcagcacatcctcctcagtgtttggcatgcagaacaatctggcccccagcttgaccaccctgtcccatggcaccaccaccacttccacagcatatggggtgaagaaaaacatgccccagagtcctgcggctgtgaacactggcgtttccacctccgccgcctgcaccacaagtgtgcagagcgatgaccttttgcacaaggactgcaagttcctgatcctagagaaagacaacacacctgccaagaaggagatggagctgctcatcatgaccaaggacagcgggaaggtctttacagcctcccctgccagcatcgctgcaacttctttttcagaagacaccctaaaaaaagaaaagcaagctgcctacaatgctgactcaggcctaaaagccgaagctaatggagacctgaagactgtgtccacaaagggcaagaccaccactgcagatatccacagctacggcagcagtggtggtggtggcagtggaggaggtggcggtgttggtggcgctggcggcggcccttggggaccagcgccagcctggtgcccctgcggctcctgctgcagctggtggaagtggctgctgggcctgctgctcacctggctgctactcctggggctgctcttcggcctcattgctctggcggaggaggtgaggaagctgaagcgcgtgtggatgagctggagaggatcaggaggagcatactgccctatggggacagcatggatagaatagaaaaggaccgcctccagggcatggcacccgcggcgggagcagacctggacaaaattgggctgcacagtgacagccaggaggagctctggatgttcgtgaggaagaagctaatgatggaacaggaaaatggaaatctccgaggaagccctggccctaaaggtattgccatggattgaaccttgtctctgattcatttcctgcagttggaagtgagttttctgggtagattagaagcctttttctttgttctaaatggaaggatgaagagctgaatgatcttatggtatctgttgggaggtatctgttggttttagagtcagaatatcttagataaggcagcatctaagagaagccc

SEQ ID NO: 320265 - DNA, 1201 bp, Homo sapiens
caggataccctgggtcggctcctccacgtgaccacccactatggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacagtatgtagtgacttaattactattcatatatctctcctttagattttaaatttatatttcctttatcttggtacatacctatttgaaaatgctactaaaataaaaataaatctttgccaaaaattttttt

SEQ ID NO: 320266 - DNA, 286 bp, Homo sapiens
tacagtggaagcattcggatctaactctccttccgggatcaagactaaggaggacctgaacgaggagcaggaagacttgagtgaactgaattcaaagctgcaagatactttggaacagattgaggaacagctggacgtagctctttccaaaatctgcaagaattttgacattaaccattataccaaatgcaaacacatctgggtctgcgatatgcacagagactttggacatacgaggaccctcgaccggaggacacctgcacaactgtcgagaaagatcctgtga

SEQ ID NO: 320267 - DNA, 4523 bp, Homo sapiens
atcataatatataatgaaataattatacaactcagcataatgtagaatcagtggaatccctgagcttgttttcctgcagttagacggtcccatctgatgggagacagtgacagatcatcaggcattagagtctcataaggagcacacaacctagattccttgcatgtgcagttcacagtagggatggagttagagctcttatgagaatctaatgccaccgctgatctgatgagaggtggagctcaggttgtaatgcaagtgatggggagcggctgtaaatacagatgaagcttcgcttgctcacctgccactcacttcctgctgtgtagcctggttccccacaggccacggaccagtactctctattagtagacaatcctgtggaacctttggaattcttaaaatgatatttaggattaacattgatatttcttcattaattaaagtctaaaagccatttaaaatttgattttcttaaccttaatggaatccctctttctagacaaaaacaatgagtgtatctaaaaattaatgtacgtaatttcaaagatgcttgaagcagattaagaaaatgtgaaaggattaatgcagtagtgtagtgggtgttcaatgttttgttctcagttggcctggggaaggggagccagttgtgtttctggagcaaactccctaaataccttctgtgtgtcctgcttcatgcctcatgtgctatctctgttagtgaagttggcagagaccctgaaatggtggaattagagcctcatgttcaaaaatcattatacttctaacttgcatacgttaatattattcatagaacaatacacacaaccttagatatcttcatagcgttccaaaaaacatgttttcagcttttcagaagtggaggaccaaactacttgcttgtcttcttaggcaacataaaggatctaaaggatacaagcaagttctttttcccagatattgtcgccataaattcagttgattaaaaatctgcttaacaatttcatctttttcaatcaaatcctattcccttaaaatggttacactttttggttaatgttacttaaatcagataatgatacacatattattaacaataataatgaccatttattgagtttctgttaaggaccaggacctgtgctatgtgctttattatattacctcttttactaatttcatagcccagggaaatgtgtatggccatagtatgccaatatctgctcccaaagttattggggagatctatggaatattcttttaaaaattcaaatataaaatatcatagaaagcatgaagtttgttcttttatttcctttgtttgattacatcttcttataggtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacacatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttggaaaatatatgcagatgatgaacattcttaagccaattgcctttgatgttattcatttcatgtctcaactatttgattattacttgtatgcaatatataccttttttggtcggaatgattcattggaatcaactggactcggccttagtagtagtagactaagaacaactctaaacagaatacaagaaagccttattgatctagaagtttcagctgatcctactgccacactcacagcagcagaagaaagaaaggagaaggtgccaagtccacacctcagtcacctagtggttttgacatctggggatacgctgtatgggttggcagaaagagtggtagccacggaatccttggtattcttggctgaacagtttgagttccttcagccacatctggatgctgtgatgcctgcagtcaaaaagccctttcttcagcagttctattctcagacagtctcaaccgccagtgaactacggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaactggattttcaacagtttttaatgaaacttgaaaaactaacagatattagacccattcctgataaagaatttgtagaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataatgaacacagctctctttcctcaatggcattgatcctcactcaacatatatgacctgaaagccagtttttttatgcacttctgacaactatctgctaagaaaactttgtgcatgtttttttgactggaaagtggaaaatattgaaatgtgtgtggtgttctcatgacttttatatgctgtggtctcttcaacttttggtctcatttgttgtaatctgaaatgatgttgccgccttgtcataacaatggttatgtgactacagttatacattttacagaagaatgtaccataagtatataattagaagaacagtggcttaatatatgtatgggaagtttatggaaaatgaagttggcacttttctaccctctgagcttggttcttaataagcataatgtgagggtgaatatgtagtatctcctaattatgagcactgcatgagaattaaaaaacacatgtaagtaaaatagttgaaaaatcagtatgttctctgtttttaaaatgtcaaagtttatgtcagggttaatttagttataacaaagtgatcataatggtgaaatttaataaatatactctagtatgatc

SEQ ID NO: 320268 - DNA, 2663 bp, Homo sapiens
caggataccctgggtcggctcctccacgtgaccacccactatggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacacatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttgacggagtctcactctgttgcctaggctggagtacagtggcgcatctccactcactgcaagctccgcctcccgggttcaagccattctcctgcctcagcctcccgcgtagctgggactacaggcgcccgccaccacgcccggctaattttttgtattttcttctttttagtagagacggggtttcaccgtgttagcggggatggtctctatctcctgacctcgtgatccgcccgcctcggcctcccaaagtgctgggattacaggcatgaaccaccgctcccagcttatcatttcttttagagaggaaccttaagggtttctattttgttttatgggtaaattctagcagcctacacctctaactgctggagaggagaggggaatggtggtggtggggaatgcagactgttacagtttgtcccatatgtgaacctgtagcttgatcgtttttcagccccgtttctgactcctgcagttccagcttgattctaagtagttactgtcctagtgaatagcttccacctcctttttggccctcttatggttttattggcttatgtttttccatcaacgtgttcccatctactgtctgtcatctacaacagacgttttgagatgtcaaatgttttgagctgctggctgcttgtttttgtaaataaagttttattggcacacccat

SEQ ID NO: 320269 - DNA, 824 bp, Homo sapiens
  misc_feature (26)..(26): n is a, c, g, or t
caggctggtacgaccctccgagttanggctatcgccgacccacgctgtcgatatgaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataatgaacacagctctctttcctcaatggcattgatcctcactcaacatatatgacctgaaagccagtttttttatgcacttctgacaactatctgctaagaaaactttgtgcatgtttttttgactggaaagtggaaaatattgaaatgtgtgtggtgttctcatgacttttatatgctgtggtctcttcaacttttggtctcatttgttgtaatctgaaatgatgttgccgccttgtcataacaatggttatgtgactacagttatacattttacagaagaatgtaccataagtatataattagaagaacagtggcttaatatatgtatgggaagtttatggaaaatgaagttggcacttttctaccctctgagcttggttcttaataagcataatgtgagggtgaatatgtagtatctcctaattatgagcactgcatgagaattaaaaaacacatgtaagtaaaatagttgaaaaatcagtatgttctctgtttttaaaatgtcaaagtttatgtcagggttaatttagttataacaaagtgatcataatggtgaaatttaataaatatactctagtatgatc

SEQ ID NO: 320270 - DNA, 645 bp, Homo sapiens
  misc_feature (29)..(29): n is a, c, g, or t
  misc_feature (35)..(35): n is a, c, g, or t
  misc_feature (73)..(73): n is a, c, g, or t
  misc_feature (87)..(87): n is a, c, g, or t
  misc_feature (133)..(133): n is a, c, g, or t
  misc_feature (138)..(138): n is a, c, g, or t
taggacttctttcttgaaaaagtgtagtnataccnatcctttccagcatacttttgaaagccagcaatcaggnactcgatgcaccgntcagtctctgtagggctgaagatttttgccatgttgaagctgagcnaggcncggaaggctgtggctgggagcggcgctgagagctctgtgcgcgcggcgtgcgggtcaggagccacttgccaccccaagtggctcatgacttttatatgctgtggtctcttcaacttttggtctcatttgttgtaatctgaaatgatgttgccgccttgtcataacaatggttatgtgactacagttatacattttacagaagaatgtaccataagtatataattagaagaacagtggcttaatatatgtatgggaagtttatggaaaatgaagttggcacttttctaccctctgagcttggttcttaataagcataatgtgagggtgaatatgtagtatctcctaattatgagcactgcatgagaattaaaaaacacatgtaagtaaaatagttgaaaaatcagtatgttctctgtttttaaaatgtcaaagtttatgtcagggttaatttagttataacaaagtgatcataatggtgaaatttaataaatatactctagtatgatc

SEQ ID NO: 320271 - DNA, 428 bp, Homo sapiens
ggaattgagaataaaatctaaatattcaaactggctagttttcttctgtagttgttagtgttaatggtcggctagttcctaatttcctgtgaacttttctgatttctgttggtttgtatccttggtcagaatcgttccaggtagatgtgactgttaagacaaatgatcatttatttccatgcagatataattttaacagctacaattactataattgtgatttttttttcttaaaggaagaattcagggaacttcgagaacagccaagtgaccctcaagctgaacaagagcttattaatagtattgaacaagtatatttttctgtggattcatttgatattgttaaatatgagctggaggtaaacagaatttcattaaaacataactaaggcctgttttgttcagtgattggatttatgagatttgaa

SEQ ID NO: 320272 - DNA, 696 bp, Homo sapiens
tgatgttattcatttcatgtctcaactatttgattattacttgtatgcaatatataccttttttggtcggaatgattcagtaagtccacctttagagggaaaaaaatctttcttttaaaatttattttataaatgtcaaagtttttcattctctctatagaagatacacaaataacattattttggggattatgcatcaaaaacaaaattattgatatcagccttctgtctgccttattgccttacttttatattaattttaagctttggtatgataaacacattcaaatttttggcagaaaaagtgcaacatctgtttctaaccttgacatattttggcaatgaaaaatgtgcaggttgctttttttaaatctggctccatctaaaatataaaacagtaaatgagacattttaaatgctggctaacaaccttagcagtcactagtatatttataagataatgatgtataagaatgcttgtgatttttgtacattgattttgtatcctgagactttgcttaaggatattttgggctgagacaatggggttttctagatatacaatcatgtcatctgcaaacagggacaatttgacttgctcttttcctaattgaataccctttatttccttctcctgcctaattgccctggccagaacttccaacactatgttgaataggagtggtgagagagggc

SEQ ID NO: 320273 - DNA, 396 bp, Homo sapiens
ccaagaatgtacataaactcatatccaaggcattcgttgcctggcatcagaatacctagaaaggtaaattagtaatgagaagatttctaatgagtatatcatcagatgaaagtaaaactgagaaatttgaagtccgatgagttttcccgaccacaaattagactgcatcactcctgttgactacatggctgtgtaactgaatcagtggttctctcctggatggtgctgaagagcctggcacaccctgcttcctgggtatccctttcctttgttcacattgaccatcttccttcttatcagcagtctgtccccagacatatacaatacagttggctctgttctagtttataacttcattctagtcctgccttcttgagattatataccagggtaacc

SEQ ID NO: 320274 - DNA, 5490 bp, Homo sapiens
atcataatatataatgaaataattatacaactcagcataatgtagaatcagtggaatccctgagcttgttttcctgcagttagacggtcccatctgatgggagacagtgacagatcatcaggcattagagtctcataaggagcacacaacctagattccttgcatgtgcagttcacagtagggatggagttagagctcttatgagaatctaatgccaccgctgatctgatgagaggtggagctcaggttgtaatgcaagtgatggggagcggctgtaaatacagatgaagcttcgcttgctcacctgccactcacttcctgctgtgtagcctggttccccacaggccacggaccagtactctctattagtagacaatcctgtggaacctttggaattcttaaaatgatatttaggattaacattgatatttcttcattaattaaagtctaaaagccatttaaaatttgattttcttaaccttaatggaatccctctttctagacaaaaacaatgagtgtatctaaaaattaatgtacgtaatttcaaagatgcttgaagcagattaagaaaatgtgaaaggattaatgcagtagtgtagtgggtgttcaatgttttgttctcagttggcctggggaaggggagccagttgtgtttctggagcaaactccctaaataccttctgtgtgtcctgcttcatgcctcatgtgctatctctgttagtgaagttggcagagaccctgaaatggtggaattagagcctcatgttcaaaaatcattatacttctaacttgcatacgttaatattattcatagaacaatacacacaaccttagatatcttcatagcgttccaaaaaacatgttttcagcttttcagaagtggaggaccaaactacttgcttgtcttcttaggcaacataaaggatctaaaggatacaagcaagttctttttcccagatattgtcgccataaattcagttgattaaaaatctgcttaacaatttcatctttttcaatcaaatcctattcccttaaaatggttacactttttggttaatgttacttaaatcagataatgatacacatattattaacaataataatgaccatttattgagtttctgttaaggaccaggacctgtgctatgtgctttattatattacctcttttactaatttcatagcccagggaaatgtgtatggccatagtatgccaatatctgctcccaaagttattggggagatctatggaatattcttttaaaaattcaaatataaaatatcatagaaagcatgaagtttgttcttttatttcctttgtttgattacatcttcttataggtatctaaaaaagtggcagatttaatccttgaaaaacagcctgcttatgtaaaggaacttgaaagagttacctcattgcagacaggtcttcaattagctgctgttatctgtacaaatgggagaaggtattgcttttgatgatattttgttctttaagctgaacaatatttcaagaataactatggaatctataatttataattgattttttaaattatggatgtggtttctagaatatcattccttaagtgaacatatatcatgatctaaagactacactaagagggtttgtgggaaatatctctaagtgtacttatgggttttaaaaaattactatttttatattatttagactagtgcttcacaaactgtttgtcgtaaagcacctacttttttctttctaaaatttccaatctgttacaggctgtgattttttaaaaatgcagtaaaaacaaattactaggcaaatgaaataaagaaggaaagacataatacagtcttaatttttttaattattagagtcacaaagaataattattctgtcagtttttgcactgtgtttttaagcgcttattctcagtttctgtaattttttgttatagaccactagcaggttgtgaattggcaccaatcttctcgtggtgttctgagtaatgctggtttagactggccattgagtacatttgtcaaatagtagtttaaatccttggttttaatagtaatccatttcactgcttcattagttacctaattgttctgtgtggatagtattcttattataataaaaaacttttaactatttattgttcacttttgcagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacacatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttggaaaatatatgcagatgatgaacattcttaagccaattgcctttgatgttattcatttcatgtctcaactatttgattattacttgtatgcaatatataccttttttggtcggaatgattcattggaatcaactggactcggccttagtagtagtagactaagaacaactctaaacagaatacaagaaagccttattgatctagatatgtttatatgaagtccaagaatgtacataaactcatatccaaggcattcgttgcctggcatcagaatacctagaaaggtaaattagtaatgagaagatttctaatgagtatatcatcagatgaaagtaaaactgagaaatttgaagtccgatgagttttcccgaccacaaattagactgcatcactcctgttgactacatggctgtgtaactgaatcagtggttctctcctggatggtgctgaagagcctggcacaccctgcttcctgggaagtttcagctgatcctactgccacactcacagcagcagaagaaagaaaggagaaggtgccaagtccacacctcagtcacctagtggttttgacatctggggatacgctgtatgggttggcagaaagagtggtagccacggaatccttggtattcttggctgaacagtttgagttccttcagccacatctggatgctgtgatgcctgcagtcaaaaagccctttcttcagcagttctattctcagacagtctcaaccgccagtgaactacggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaactggattttcaacagtttttaatgaaacttgaaaaactaacagatattagacccattcctgataaagaatttgtagaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataatgaacacagctctctttcctcaatggcattgatcctcactcaacatatatgacctgaaagccagtttttttatgcacttctgacaactatctgctaagaaaactttgtgcatgtttttttgactggaaagtggaaaatattgaaatgtgtgtggtgttctcatgacttttatatgctgtggtctcttcaacttttggtctcatttgttgtaatctgaaatgatgttgccgccttgtcataacaatggttatgtgactacagttatacattttacagaagaatgtaccataagtatataattagaagaacagtggcttaatatatgtatgggaagtttatggaaaatgaagttggcacttttctaccctctgagcttggttcttaataagcataatgtgagggtgaatatgtagtatctcctaattatgagcactgcatgagaattaaaaaacacatgtaagtaaaatagttgaaaaatcagtatgttctctgtttttaaaatgtcaaagtttatgtcagggttaatttagttataacaaagtgatcataatggtgaaatttaataaatatactctagtatgatc

SEQ ID NO: 320275 - DNA, 3608 bp, Homo sapiens
caggataccctgggtcggctcctccacgtgaccacccactatggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacacatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttggaaaatatatgcagatgatgaacattcttaagccaattgcctttgatgttattcatttcatgtctcaactatttgattattacttgtatgcaatatataccttttttggtcggaatgattcattggaatcaactggactcggccttagtagtagtagactaagaacaactctaaacagaatacaagaaagccttattgatctagaagtttcagctgatcctactgccacactcacagcagcagaagaaagaaaggagaaggtgccaagtccacacctcagtcacctagtggttttgacatctggggatacgctgtatgggttggcagaaagagtggtagccacggaatccttggtattcttggctgaacagtttgagttccttcagccacatctggatgctgtgatgcctgcagtcaaaaagccctttcttcagcagttctattctcagacagtctcaaccgccagtgaactacggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaactggattttcaacagtttttaatgaaacttgaaaaactaacagatattagacccattcctgataaagaatttgtagaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataatgaacacagctctctttcctcaatggcattgatcctcactcaacatatatgacctgaaagccagtttttttatgcacttctgacaactatctgctaagaaaactttgtgcatgtttttttgactggaaagtggaaaatattgaaatgtgtgtggtgttctcatgacttttatatgctgtggtctcttcaacttttggtctcatttgttgtaatctgaaatgatgttgccgccttgtcataacaatggttatgtgactacagttatacattttacagaagaatgtaccataagtatataattagaagaacagtggcttaatatatgtatgggaagtttatggaaaatgaagttggcacttttctaccctctgagcttggttcttaataagcataatgtgagggtgaatatgtagtatctcctaattatgagcactgcatgagaattaaaaaacacatgtaagtaaaatagttgaaaaatcagtatgttctctgtttttaaaatgtcaaagtttatgtcagggttaatttagttataacaaagtgatcataatggtgaaatttaataaatatactctagtatgatc

SEQ ID NO: 320276 - DNA, 4336 bp, Homo sapiens
aatagagatatatctgtggatggtagagttggggttaggttagttactgtctcacattctcctgtcacaggccgtggcagcagtgtctgtcggcctagggtccagagtccccagtggtagtggggtttctcagaaggcagagcagcagcagtgggggtaacaaggctgaatgaggggtggaaccagagggctgtgtactaaagatgtataggcttttgtggttggaacctaggagggaggttgggaggacaggtggcatggagggcagtgggatgtgacactgttttgtatgcacagtttgtagttcactagtcagaagggtccaggtaaatgaaaccaaattaaacaatttattttttcctcttctttcatgaatttttttctgtagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaaggtattgcttttgatgatattttgttctttaagctgaacaatatttcaagaataactatggaatctataatttataattgattttttaaattatggatgtggtttctagaatatcattccttaagtgaacatatatcatgatctaaagactacactaagagggtttgtgggaaatatctctaagtgtacttatgggttttaaaaaattactatttttatattatttagactagtgcttcacaaactgtttgtcgtaaagcacctacttttttctttctaaaatttccaatctgttacaggctgtgattttttaaaaatgcagtaaaaacaaattactaggcaaatgaaataaagaaggaaagacataatacagtcttaatttttttaattattagagtcacaaagaataattattctgtcagtttttgcactgtgtttttaagcgcttattctcagtttctgtaattttttgttatagaccactagcaggttgtgaattggcaccaatcttctcgtggtgttctgagtaatgctggtttagactggccattgagtacatttgtcaaatagtagtttaaatccttggttttaatagtaatccatttcactgcttcattagttacctaattgttctgtgtggatagtattcttattataataaaaaacttttaactatttattgttcacttttgcagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacacatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttggaaaatatatgcagatgatgaacattcttaagccaattgcctttgatgttattcatttcatgtctcaactatttgattattacttgtatgcaatatataccttttttggtcggaatgattcattggaatcaactggactcggccttagtagtagtagactaagaacaactctaaacagaatacaagaaagccttattgatctagaagtttcagctgatcctactgccacactcacagcagcagaagaaagaaaggagaaggtgccaagtccacacctcagtcacctagtggttttgacatctggggatacgctgtatgggttggcagaaagagtggtagccacggaatccttggtattcttggctgaacagtttgagttccttcagccacatctggatgctgtgatgcctgcagtcaaaaagccctttcttcagcagttctattctcagacagtctcaaccgccagtgaactacggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaactggattttcaacagtttttaatgaaacttgaaaaactaacagatattagacccattcctgataaagaatttgtagaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataatgaacacagctctctttcctcaatggcattgatcctcactcaacatatatgacctgaaagccagtttttttatgcacttctgacaactatctgctaagaaaactttgtgcatgtttttttgactggaaagtggaaaatattgaaatgtgtgtggtgttctcatgacttttatatgctgtggtctcttcaacttttggtctcatttgttgtaatctgaaatgatgttgccgccttgtcataacaatggttatgtgactacagttatacattttacagaagaatgtaccataagtatataattagaagaacagtggcttaatatatgtatgggaagtttatggaaaatgaagttggcacttttctaccctctgagcttggttcttaataagcataatgtgagggtgaatatgtagtatctcctaattatgagcactgcatgagaattaaaaaacacatgtaagtaaaatagttgaaaaatcagtatgttctctgtttttaaaatgtcaaagtttatgtcagggttaatttagttataacaaagtgatcataatggtgaaatttaataaatatactctagtatgatc

SEQ ID NO: 320277 - DNA, 2885 bp, Homo sapiens
caggataccctgggtcggctcctccacgtgaccacccactatggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacacatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttgacggagtctcactctgttgcctaggctggagtacagtggcgcatctccactcactgcaagctccgcctcccgggttcaagccattctcctgcctcagcctcccgcgtagctgggactacaggcgcccgccaccacgcccggctaattttttgtattttcttctttttagtagagacggggtttcaccgtgttagcggggatggtctctatctcctgacctcgtgatccgcccgcctcggcctcccaaagtgctgggattacaggcatgaaccaccgctcccagcttatcatttcttttagagaggaaccttaagggtttctattttgttttatgggtaaattctagcagcctacacctctaactgctggagaggagaggggaatggtggtggtggggaatgcagactgttacagtttgtcccatatgtgaacctgtagcttgatcgtttttcagccccgtttctgactcctgcagttccagcttgattctaagtagttactgtcctagtgaatagcttccacctcctttttggccctcttatggttttattggcttatgtttttccatcaacgtgttcccatctactgtctgtcatctacaacagacgttttgagatgtcaaatgttttgagctgctggctgcttgtttttgtaaataaagttttattggcacacccatgctcatttgtttgcatattgtctgtctgtagctgcttttgtgctacagtggcatagttgagcagttgaaacagaagacagcagagcagaattgttgccacagagactgtgcggtatgcaaagcctaaactatctactcttgggtcctttacaggaaaagtttgccaacctctggtctagaaatgttttgacatttttcattttcttgtgctcaaacctacca

SEQ ID NO: 320278 - DNA, 3598 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320279 - DNA, 698 bp, Homo sapiens
ccccgactagcccgacagggacgtccaaggaatctgtgcatttcaagaaacaaagttcatcagcttctctcctaaggtattgccctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320280 - DNA, 583 bp, Homo sapiens
ccggcctccagaaattgggccccaggtggtttcctgagactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320281 - DNA, 837 bp, Homo sapiens
aagtgaattcgtgctggtgctaagggaattcgtgctggtgctaagggaattcggatggtgctacctttagggtgggtgaggtctgggtgagccaggcaagccttccccaatcttaatattttcttaagctttgaggacagaggtcttcccagcctgcttttgtgggaaagggataggatttaggcatataataagtttgagagccccaagtaccagtgtgaagcatataatttatattcagttacttccctgctgcctcccctgccaattttccttttcagcacttctattattaataggccatcaccctcaaggaccagtgcttccacccatatataactctcaaactactccaaccagacatgtcttatcaatcccaatgactttgaacattacccacctactcctcaagatcagatgacactttcctccttccaggcttctccaaagttctgcttggtgacagggtgctgataagagtatctttcccaagtgttttctttcttcttcttctttttttttttttttttttttgagacggaatttggtcttgttgcccaggctggagggcaatggcacgatatcggctcaccacagcctctcctcctgggctcccgggttcaagcaattctcctgcttcagcctcctgaggagctgggattacaggcatgcgccaccacacccggctaattttgtatttttagtagagatgggtttctccatgttagtgagactggtcttgaactcctgacctcaggtgatctgcccacctcagcctcccaaagtgctaggattacaggcgtgagccaccacgcccggccaggtgttttatttcta

SEQ ID NO: 320282 - DNA, 3902 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgcaaaaaaaaaaaaaaaaaaaaaaaaaaaaaaacattttggttcgggccggactacgggcctccggaagacggttttcataaacaccactcgggttggggccgcgagggccccaaatagggaaggggcgacgttggccacaacgcgtggtccccagagaacaccgggcgcagcagcaaggcgtggggttctcccacgaataaaaaagcgcgcggggggaaccaccgggtgtctgagcaacccagaagagtcccggagcgctaggggctaccaacgggccagggggctgaatcaatacagcccggggg

SEQ ID NO: 320283 - DNA, 3870 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgcaactcatcaaacatagtgactcaatgtcatcaaggtcagagtctactaggggacacccgcttctacaatgtgcccccagggatagggtcccgcaaggtctgaggtccacccccatgattatttgccgcagcggaggccccgcgttgaaagggcggatccatagcactacctcaccaggccgtcatgttgtcccagcgggcttggcggagcataaccgcaggagggacacacttctggcggacgacctgcctcctggggggtgccctatatcga

SEQ ID NO: 320284 - DNA, 4082 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgcatttggagccgaccttcatctttgctgtgcagcagccgtgggacagtagtttcatggtgaggggagtcctgtttctggtccctctctccatagtgctccttctttcagcaaaggggtaaaaggcacacttgattgatagagagtaaggttatggaggaacttagtgccactccacactggttatttcttcccatcataccccgcggcgggggagcccaaatgaattgggcatcagagtgtgagggcttcgtgactttcctcctctagttctaaagggtttaaacctgaaatcagctgtatttctcacctgttggtagactgtatggacttcactggctgaagggccctgaacttggagggccccatgtgcctctactctcagatctcctcagccttgcacatgaggtgcttctagtttgaacagagaccccctcactagtctagttctggactttggcagtgaataaacatgaaggataaacgtc

SEQ ID NO: 320285 - DNA, 3650 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgcaaaaaaccccaaccacacaacaaaaagggggccccaaaaataccccgggggcc

SEQ ID NO: 320286 - DNA, 3594 bp, Homo sapiens
gtgcctgtcgcggcttccggtgctacggtggagtggaatgtgacaggatgtgtgacgccggaggagtgggtgccatgggcatgcatgcctgtgtgcttgaatgtctgtcgcttggtggatgccagcagggatgctggagctggatactctgctgtggtgcaggatgtgctgtgctgtgactgcatgctgtgctgcagcttgatagcagtgaacagtgatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320287 - DNA, 4180 bp, Homo sapiens
ccacgatcacccgaaacccagagggtgagagagagaggggccaccccatgaaaccgtaacagctgttttgttttaaatccagtaaattggaagtgactcatcatctaggacagcaattagggattggtcatatatggtggacaggaaaaaggaggaatgtggtggtggaggtggaggattgtggtatgtggtcaggagtgagaagaaatagtaaggccgtcccggtgagggagaaatgtaacctaaaacctgtctctgctgttgttggattgggtcacccctggtctatggcatgaaagttttattgggaggagatctgctgcaagagtctgattgcttgggtcagtgcaacaggacagaatctagtcgctgcatacctccttccctgtcctcaatcaggtaggtagtaacagtctttgctgctattttgtcttgggcttgttgttggggtaggtgtttccacttgccgtgacttgggacatgggacagtgttatgggacagtggattatcatagcccattggacttgagtttgaaaaacatgtctgtaaaagttcattctaagaaagaaactaatccattaaggttcagcttttcaccgaatgaatgattgaccttggattcagccaggaaaggctcccatgtatcacatattcacatgcgtcctgtttcccagcatagaattattaccttgcatagttagaatttttatagttgtctatcttgcttttccaaagagactagacgcttttcgactgcaggaactggatttcgtctcctcttccacaatgcccatgcaaacagatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320288 - DNA, 3839 bp, Homo sapiens
cgcgaatcgtttgagggaaggggcgggagttggggaggtggagttccctgttaaaacgggccacttgattagcaaagtggtagctgttattttgggggaattcccgtcttgattgcattaaggcgggtctccatctttccaggccaggaggaatgtggtggtggaggtggaggattgtggtatgtggtcaggagtgagaagaaatagtaaggccgtcccggtgagggagaaatgtaacctaaaacctgtctctgctgttgttggattgggtcacccctggtctatggcatgaaagttttattgggaggagatctgctgcaagagtctgattgcttgggtcagtgcaacaggacagaatctagtcgctgcatacctccttccctgtcctcaatcagagactagacgcttttcgactgcaggaactggatttcgtctcctcttccacaatgcccatgcaaacagatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320289 - DNA, 3416 bp, Homo sapiens
  misc_feature (1)..(1): n is a, c, g, or t
  misc_feature (14)..(14): n is a, c, g, or t
  misc_feature (29)..(29): n is a, c, g, or t
  misc_feature (37)..(37): n is a, c, g, or t
ngtcggccagctgnagtagcaggttcatnaaatcatnagatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320290 - DNA, 3255 bp, Homo sapiens
tgatctaaggatcccctgtctcagttcgggacgttagtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320291 - DNA, 3511 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtatttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320292 - DNA, 3447 bp, Homo sapiens
agctatgtaagtatagagattgcacatcgtgcctgagcactctccagttggtctagaaagtcgttccatggacaaacaaatacctggagacacgctttacaccactcctcattcggaaacgtaggccaatgtctcttttctcttttccttagtcctttcagtgtctaggcggatctgatggataactcagagctcatcagaaatgtgacccttggtggacatctccaccatggcaaggtaagagagaactttcagctacttggaacaggatttctcttttgtacctgctcatgtctgagcccttagagtcggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320293 - DNA, 3279 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgtttaataactcaccttctctatccttgctcaaaatgtgggataacgcgatgactgtgaccctggttggaaattaaacttgttttatgca

SEQ ID NO: 320294 - DNA, 3169 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320295 - DNA, 2952 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320296 - DNA, 3235 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgatataatttatatttttttttatattatattattttttatattttattttaattttttttattttattatttttatatatttatttattattttaatattattttttattttttttttattttttttttacttatttattcttttttttctgtattttattttatttttttctttattactcatttttttctcttcttttcttttatttttcgttttttttctctcttctgtttttttttcttttctcttcctatcttttttctcttatcttttttcttcttcttatttctatttactctttgttttctgctttgtttgttgttcgatttattctttttctttttacttatcttttttgtattttttcttttttttctatctactctcttttttatctctctttttgttttctcttacttctcttcccttttttcctccc

SEQ ID NO: 320297 - DNA, 2645 bp, Homo sapiens
tcaagcttctaacgatgtacggggacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320298 - DNA, 2242 bp, Homo sapiens
aaggctgatgtcaataaggtgctgagtgcctcggggtgttttaatatcaaggcgacggaagggggcccgcttggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320299 - DNA, 1868 bp, Homo sapiens
aaccacttcaggattttatttcctccactctaacccccagatccatttatgagaagtgggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320300 - DNA, 1374 bp, Homo sapiens
gggctaggtgcgaggctgggtgtcggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320301 - DNA, 1386 bp, Homo sapiens
cgagctaggtacgaggctggtgtgaatcggccgaggggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320302 - DNA, 1492 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320303 - DNA, 1125 bp, Homo sapiens
aaaatgagtaatgaggtcagagaccgagtgttaagtcggacgaggcacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320304 - DNA, 955 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccctctccctgaaataaagaacagcttgacagaaaaa

SEQ ID NO: 320305 - DNA, 925 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccactcaatttgagatcctctagagtaccgcagata

SEQ ID NO: 320306 - DNA, 1691 bp, Homo sapiens
tttgcgtggtcacttacgggcgtttgcgtggtgcacttacgacccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgcatttggagccgaccttcatctttgctgtgcagcagccgtgggacagtagtttcatggtgaggggagtcctgtttctggtccctctctccatagtgctccttctttcagcaaaggggtaaaaggcacacttgattgatagagagtaaggttatggaggaacttagtgccactccacactggttatttcttcccatcataccccgcggcgggggagcccaaatgaattgggcatcagagtgtgagggcttcgtgactttcctcctctagttctaaagggtttaaacctgaaatcagctgtatttctcacctgttggtagactgtatggacttcactggctgaagggccctgaacttggagggccccatgtgcctctactctcagatctcctcagccttgcacatgaggtgcttctagtttgaacagagaccccctcactagtctagttctggactttggcagtgaataaacatgaaggataaacgtctgggcagtgtaatgaccttaatccttcttacaactgatggccctgcatcagctctacttcaggcgtgtggtttttcattgtcaggatgccaagcctcatccagagatcccacaaatgtcttgaggaatagaccttttccataaagcctccatcctcccatcgcactcccaccactattctgttcctcccctgctaccagtgtctggctccaggcaaagaaagggatggtgctacctttagggtgggtgaggtctgggtgagccaggcaagccttccccaatcttaatattttcttaagctttgaggacagaggtcttcccagcctgcttttgtgggaaagggataggatttaggcatataataagtttgagagccccaagtaccagtgtgaagcatataatttatattcagttacttccctgctgcctcccctgccaattttccttttcagcacttctattattaataggccatcaccctcaaggaccagtgcttccacccatatataactctcaaactactccaaccagacatgtcttatcaatcccaatgactttgaacattacccacctactcctcaagatcagatgacactttcctccttccaggcttctccaaagttctgcttggtgacagggtgctgataagagtatctttcccaagtgttttctttcttcttcttctttttttttttttttttttttgagacggaatttggtcttgttgcccaggctggagggcaatggcacgatatcggctcaccacagcctctcctcctgggctcccgggttcaagcaattctcctgcttcagcctcctgaggagctgggattacaggcatgcgccaccacacccggctaattttgtatttttagtagagatgggtttctccatgttagtgagactggtcttgaactcctgacctcaggtgatctgcccacctcagcctcccaaagtgctaggattacaggcgtgagccaccacgcccggccaggtgttttatttcta

SEQ ID NO: 320307 - DNA, 3708 bp, Homo sapiens
gtgcagatcttggtggtaggttgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagccggtgcagatctgggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320308 - DNA, 5089 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgcatttggagccgaccttcatctttgctgtgcagcagccgtgggacagtagtttcatggtgaggggagtcctgtttctggtccctctctccatagtgctccttctttcagcaaaggggtaaaaggcacacttgattgatagagagtaaggttatggaggaacttagtgccactccacactggttatttcttcccatcataccccgcggcgggggagcccaaatgaattgggcatcagagtgtgagggcttcgtgactttcctcctctagttctaaagggtttaaacctgaaatcagctgtatttctcacctgttggtagactgtatggacttcactggctgaagggccctgaacttggagggccccatgtgcctctactctcagatctcctcagccttgcacatgaggtgcttctagtttgaacagagaccccctcactagtctagttctggactttggcagtgaataaacatgaaggataaacgtctgggcagtgtaatgaccttaatccttcttacaactgatggccctgcatcagctctacttcaggcgtgtggtttttcattgtcaggatgccaagcctcatccagagatcccacaaatgtcttgaggaatagaccttttccataaagcctccatcctcccatcgcactcccaccactattctgttcctcccctgctaccagtgtctggctccaggcaaagaaagggatggtgctacctttagggtgggtgaggtctgggtgagccaggcaagccttccccaatcttaatattttcttaagctttgaggacagaggtcttcccagcctgcttttgtgggaaagggataggatttaggcatataataagtttgagagccccaagtaccagtgtgaagcatataatttatattcagttacttccctgctgcctcccctgccaattttccttttcagcacttctattattaataggccatcaccctcaaggaccagtgcttccacccatatataactctcaaactactccaaccagacatgtcttatcaatcccaatgactttgaacattacccacctactcctcaagatcagatgacactttcctccttccaggcttctccaaagttctgcttggtgacagggtgctgataagagtatctttcccaagtgttttctttcttcttcttctttttttttttttttttttttgagacggaatttggtcttgttgcccaggctggagggcaatggcacgatatcggctcaccacagcctctcctcctgggctcccgggttcaagcaattctcctgcttcagcctcctgaggagctgggattacaggcatgcgccaccacacccggctaattttgtatttttagtagagatgggtttctccatgttagtgagactggtcttgaactcctgacctcaggtgatctgcccacctcagcctcccaaagtgctaggattacaggcgtgagccaccacgcccggccaggtgttttatttcta

SEQ ID NO: 320309 - DNA, 3663 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgcaaaaaaaaaaggggggcggcaaaaaatcccgaggggccaagtaggtaccgttttgcaatggcccaa

SEQ ID NO: 320310 - DNA, 3648 bp, Homo sapiens
gagctgtagtcgctagcctaagccagagccacagcaacgtgggacccgaaatgcttctgtgacctcctccacagctcagagcaatgccagacccttaacccacagagcaaggccagggatggaacctgcgtcctcatggatactagtcagattcgtttccgctgagccacaaggggaactccaggaatgccgcatgtccgcatgttcgcttaagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320311 - DNA, 4087 bp, Homo sapiens
tgagctggggaggggaagtaaaggcgtccttaatcgtgtctccacctgccttccaagatgctgccttcgattttgttttgagtaagggatgataagccatcctcttgagaagaaatagtaaggccgtcccggtgagggagaaatgtaacctaaaacctgtctctgctgttgttggattgggtcacccctggtctatggcatgaaagttttattgggaggagatctgctgcaagagtctgattgcttgggtcagtgcaacaggacagaatctagtcgctgcatacctccttccctgtcctcaatcaggtaggtagtaacagtctttgctgctattttgtcttgggcttgttgttggggtaggtgtttccacttgccgtgacttgggacatgggacagtgttatgggacagtggattatcatagcccattggacttgagtttgaaaaacatgtctgtaaaagttcattctaagaaagaaactaatccattaaggttcagcttttcaccgaatgaatgattgaccttggattcagccaggaaaggctcccatgtatcacatattcacatgcgtcctgtttcccagcatagaattattaccttgcatagttagaatttttatagttgtctatcttgcttttccaaagagactagacgcttttcgactgcaggaactggatttcgtctcctcttccacaatgcccatgcaaacagatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320312 - DNA, 3569 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaacttgagcccagaggaccactcgagcccacgtaatcgtgactacagctgtacactgccatacctggttattcgcttattattgtaaagatagggtttcgtcacattgcccaggctagtctcaaacccg

SEQ ID NO: 320313 - DNA, 3495 bp, Homo sapiens
  misc_feature (250)..(250): n is a, c, g, or t
  misc_feature (275)..(275): n is a, c, g, or t
gcagctggctgcgcgtcctggaggggcctgccgagcctccacccatgattcaagcctccatgatctgatcttcaattctctgaactatctgcgaggaaccatgactagggactggcaggtacctatggggcctgcgaagggttctgggtgatgagcttctgcccgatgcaatcatgtggtgcgacgtatgtcctggatgatccctgtccatttacgtcctagaagttcgagtgaactgaggtatcattgncacggtcacatgactagggatcagncctgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320314 - DNA, 3159 bp, Homo sapiens
ttgcctgttttttttccaaaggggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320315 - DNA, 3237 bp, Homo sapiens
gtgcagatcttggtggtaggttgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagccggtgcagatctgggtgctaggtggagggaaggaaggagggagccggggagtgggccaggcagccaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320316 - DNA, 3022 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320317 - DNA, 2870 bp, Homo sapiens
gtgcagatcttggtggtaggttgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagccggtgcagatctgggtgctaggtggagggaaggaaggagggagccggggagtgggccaggcagccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320318 - DNA, 2872 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320319 - DNA, 1050 bp, Homo sapiens
agcggaggtgggaagtatcccgggctgggggtgggggtacgccgcacagctccagtcgccgtcgcggcttccggtgctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320320 - DNA, 944 bp, Homo sapiens
agacattcaagagctaatggtcacgtcagaggaattaacagaagacaacttgatgaagaagagtgcttccaaaccagtgccagacggtcaggaagcagcacgccgaagcagtgccagaaaacaaatctactttagacaatctggcagaagggttacaattatccaagagtgcttttgatttatttttaggacacaaaccctgctatgacacaggcactaaaattaaagccaacggtggaagaagaattggcgccatggtatagaaacatttttagagaaatgaaaaagcaaaaaagttggacagaaattattatttctgtaaagttacacctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 320321 - DNA, 1692 bp, Homo sapiens
ctaaggcgccatcagccgcccgggagatatccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatgcattcatggctctggacgcattggctgatggtggggtgaagatgggtttgccacggcgcctggcaatccaactcggggcccaggctttgctgggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatctgtcccctctgtgattcagagcccttagttgagagccctcctcagctgtgcaaggagaaagcatgcttaggaagttttcaggtccttgtgataaaacctccttaaatctgttcagaccaagcaatgcgagcttcctctcctgtcccatgttggaagttgctctgaaggggtggtagatgctggaagccagacacaaccctgcgtacgctgctcagttggtggagactggggctgggactggagtcagcccagctgggaggaggggctggggaggatctgcagctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaatatc

SEQ ID NO: 320322 - DNA, 1637 bp, Homo sapiens
ctaaggcgccatcagccgcccgggagatatccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatgcattcatggctctggacgcattggctgatggtggggtgaagatgggtttgccacggcgcctggcaatccaactcggggcccaggctttgctgggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatctgtcccctctgtgattcagagcccttagttgagagcccctgccgcccctgccacccccctgccccgctcccaccattgcccctcctcagctgtgcaaggagaaagcatgcttaggaagttttcaggtccttgtgataaaacctccttaaatgctgctcagttggtggagactggggctgggactggagtcagcccagctgggaggaggggctggggaggatctgcagctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaatatc

SEQ ID NO: 320323 - DNA, 1899 bp, Homo sapiens
  misc_feature (1213)..(1213): n is a, c, g, or t
ctaaggcgccatcagccgcccgggagatatccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatgcattcatggctctggacgcattggctgatggtggggtgaagatgggtttgccacggcgcctggcaatccaactcggggcccaggctttgctgggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatctgtcccctctgtgattcagagcccttagttgagagccctgggcgnctggaccctggccgggaatggatcagacggagcaaagggcagaaagcattgacgtaagagagccgggtgtacagaggtcatgcagagtaacaaacaacacggagaggtactgagcagaaagagggcgaaaagacaaacgacaaggatcaacaaggaagcaactggggggacagaaggctcattgacccacaggcgcccgcacacacatgccacgacgaaccccaagacaaccacaacccatggaggaaagccaggacggaaagcagaacaacaagggcgagcgcgaacagaaacacaccaaatggcaagaggggaacagacagagtggaaagcaggcgacgcacgagtaccagaggcaggagtgcaatacaaggaaacgtcgacacgacgaaaaagcaaagcagctcacaggaagcggagaccacaacgaacacaaccacagccagcatccggccaccacaacacgcacaccaaccaaaccggaaggacaacagagaagacacaacaccaaagacgcctacctaccccggcaacaccaacagacagaccgcacaagaggcaggcagaagaggagcaacaggagcgaaacgtaccaatgagagagacaaaaagtgagaggaaaaacggacaagaaaaggtgagacgagacacaccaggaggatccgaagcagaaagaatacaaatga

SEQ ID NO: 320324 - DNA, 3186 bp, Homo sapiens
ctaaggcgccatcagccgcccgggagatatccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcaagcgcgtggaggcgggaggcggcttcgcgggcggtcccgaggcccgagggggcctccgtcccaccagcatgagcgaatgaaaggggagtttgcgtccggtggggtagatgagactctggttgagcagcaagcatcctgtcggctcacaagataatagccagctccccagaaatgaacctgcccacggtgtccgcgctcagggtaggtggagccgggcggagtgggaagcgggtggaggcccaggaaaaggatgacctgagatgaagtgagtctggccggcccctgcgcccaagtgctggtctttggccggcggtgacctttactccaggaacgtgacaatctttccaccttctcttgggcagctcaatgtggtgggaacacccagggagacataactgggggtcagatccagacactggagtggtagaggattaactgaggtgattatgtgatgaaagcacctggcacatagtaggtacctaataaatactcattttttaaattttttttcagacagggtcttactctgtcgcccaagctggagtgcagtggcgcgatctcagctcactgtaacctccgcctcccacctcagcctcccacctcagcctcccgagtagctggaattacaggcatccaccacgcgcagctaatttttgtatttttggtagagaatactgttggccaggctggtctcgaactcctggcctcaagtgatctgcccgccttggcctcccaaagtgctgggattacaggggtgagccactgcgctcagccatttttcttaatagacgagttgtatgaccttaaagtactcagccactttgaggctatttcctcatttacaacagtggccactttgctgttattctgagtcgtgaatgagcatattgggaagaatctggtgagttagttgttctgttctccaaaaacatattccaagtcttcacccaaaacctgtgctctgtgggagaggatggctgatgaggcaggtgacaggcagtgtctgtgcctagggtgggctgatgtccctagcactggagggtcctgcttctcagtttggagtcatagagggatggatggcttccagcctagccctggaccacatggagactgtgcggtccccacgaacaagcggccagggttaggatagggcctgactcagctgtgcttttaacgaccaggtattagcatttccctttgccctgccactttcaccatagggccttcttacctggcagaggagtgccttagataccagaagattggcagggaagaagggcagccacttcctggttaccatggagaagcttgtcatgctccaagcctgtgcttacttgtccagtagcaacaatgggaaactgtattatttggggtaggggtagaaccctgagggcataaagctaagaattccaggctgcatctggcagaatcggtttggcaggggttcagctgctccctgggaggccttggcatagccaggctgctccagcactgtgagctgggagtctcctcttgcagaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatgcattcatggctctggacgcattggctgatggtggggtgaagatgggtttgccacggcgcctggcaatccaactcggggcccaggctttgctgggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatctgtcccctctgtgattcagagcccttagttgagagcccctgccgcccctgccacccccctgccccgctcccaccattgcccctcctcagctgtgcaaggagaaagcatgcttaggaagttttcaggtccttgtgataaaacctccttaaatctgttcagaccaagcaatgcgagcttcctctcctgtcccatgttggaagttgctctgaaggggtggtagatgctggaagccagacacaaccctgcgtacgctgctcagttggtggagactggggctgggactggagtcagcccagctgggaggaggggctggggaggatctgcagctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaatatc

SEQ ID NO: 320325 - DNA, 1869 bp, Homo sapiens
ctaaggcgccatcagccgcccgggagatatccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcaagcgcgtggaggcgggaggcggcttcgcgggcggtcccgaggcccgagggggcctccgtcccaccagcatgagcgaatgaaaggggagtttgcgtccggtggggtagatgagactctggttgagcagcaagcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatgcattcatggctctggacgcattggctgatggtggggtgaagatgggtttgccacggcgcctggcaatccaactcggggcccaggctttgctgggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatctgtcccctctgtgattcagagcccttagttgagagcccctgccgcccctgccacccccctgccccgctcccaccattgcccctcctcagctgtgcaaggagaaagcatgcttaggaagttttcaggtccttgtgataaaacctccttaaatctgttcagaccaagcaatgcgagcttcctctcctgtcccatgttggaagttgctctgaaggggtggtagatgctggaagccagacacaaccctgcgtacgctgctcagttggtggagactggggctgggactggagtcagcccagctgggaggaggggctggggaggatctgcagctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaatatc

SEQ ID NO: 320326 - DNA, 1665 bp, Homo sapiens
ctaaggcgccatcagccgcccgggagatatccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcagaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatgcattcatggctctggacgcattggctgatggtggggtgaagatgggtttgccacggcgcctggcaatccaactcggggcccaggctttgctgggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatctgtcccctctgtgattcagagcccttagttgagagcccctgccgcccctgccacccccctgccccgctcccaccattgcccctcctcagctgtgcaaggagaaagcatgcttaggaagttttcaggtccttgtgataaaacctccttaaatctgttcagaccaagcaatgcgagcttcctctcctgtcccatgttggaagttgctctgaaggggtggtagatgctggaagccagacacaaccctgcgtacgctgctcagttggtggagactggggctgggactggagtcagcccagctgggaggaggggctggggaggatctgcagctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaatatc

SEQ ID NO: 320327 - DNA, 939 bp, Homo sapiens
ctaaggcgccatcagccgcccgggagatatccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggatctgcagctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaatatc

SEQ ID NO: 320328 - DNA, 3177 bp, Homo sapiens
ctaaggcgccatcagccgcccgggagatatccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcatcctgtcggctcacaagataatagccagctccccagaaatgaacctgcccacggtgtccgcgctcagggtaggtggagccgggcggagtgggaagcgggtggaggcccaggaaaaggatgacctgagatgaagtgagtctggccggcccctgcgcccaagtgctggtctttggccggcggtgacctttactccaggaacgtgacaatctttccaccttctcttgggcagctcaatgtggtgggaacacccagggagacataactgggggtcagatccagacactggagtggtagaggattaactgaggtgattatgtgatgaaagcacctggcacatagtaggtacctaataaatactcattttttaaattttttttcagacagggtcttactctgtcgcccaagctggagtgcagtggcgcgatctcagctcactgtaacctccgcctcccacctcagcctcccacctcagcctcccgagtagctggaattacaggcatccaccacgcgcagctaatttttgtatttttggtagagaatactgttggccaggctggtctcgaactcctggcctcaagtgatctgcccgccttggcctcccaaagtgctgggattacaggggtgagccactgcgctcagccatttttcttaatagacgagttgtatgaccttaaagtactcagccactttgaggctatttcctcatttacaacagtggccactttgctgttattctgagtcgtgaatgagcatattgggaagaatctggtgagttagttgttctgttctccaaaaacatattccaagtcttcacccaaaacctgtgctctgtgggagaggatggctgatgaggcaggtgacaggcagtgtctgtgcctagggtgggctgatgtccctagcactggagggtcctgcttctcagtttggagtcatagagggatggatggcttccagcctagccctggaccacatggagactgtgcggtccccacgaacaagcggccagggttaggatagggcctgactcagctgtgcttttaacgaccaggtattagcatttccctttgccctgccactttcaccatagggccttcttacctggcagaggagtgccttagataccagaagattggcagggaagaagggcagccacttcctggttaccatggagaagcttgtcatgctccaagcctgtgcttacttgtccagtagcaacaatgggaaactgtattatttggggtaggggtagaaccctgagggcataaagctaagaattccaggctgcatctggcagaatcggtttggcaggggttcagctgctccctgggaggccttggcatagccaggctgctccagcactgtgagctgggagtctcctcttgcagaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaaggtgcccatctcagccctgatgccccttgtgtgaggggagggttgacccacgaatggcagctaatgggtgggtgctggtgggagccgtgccctggccactcattcggctctctccctcaccctagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatgcattcatggctctggacgcattggctgatggtggggtgaagatgggtttgccacggcgcctggcaatccaactcggggcccaggctttgctgggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatctgtcccctctgtgattcagagcccttagttgagagcccctgccgcccctgccacccccctgccccgctcccaccattgcccctcctcagctgtgcaaggagaaagcatgcttaggaagttttcaggtccttgtgataaaacctccttaaatctgttcagaccaagcaatgcgagcttcctctcctgtcccatgttggaagttgctctgaaggggtggtagatgctggaagccagacacaaccctgcgtacgctgctcagttggtggagactggggctgggactggagtcagcccagctgggaggaggggctggggaggatctgcagctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaatatc

SEQ ID NO: 320329 - DNA, 1736 bp, Homo sapiens
ctaaggcgccatcagccgcccgggagatatccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatgcattcatggctctggacgcattggctgatggtggggtgaagatgggtttgccacggcgcctggcaatccaactcggggcccaggctttgctgggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatctgtcccctctgtgattcagagcccttagttgagagcccctgccgcccctgccacccccctgccccgctcccaccattgcccctcctcagctgtgcaaggagaaagcatgcttaggaagttttcaggtccttgtgataaaacctccttaaatctgttcagaccaagcaatgcgagcttcctctcctgtcccatgttggaagttgctctgaaggggtggtagatgctggaagccagacacaaccctgcgtacgctgctcagttggtggagactggggctgggactggagtcagcccagctgggaggaggggctggggaggatctgcagctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaatatc

SEQ ID NO: 320330 - DNA, 3325 bp, Homo sapiens
ctaaggcgccatcagccgcccgggagatatccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcaagcgcgtggaggcgggaggcggcttcgcgggcggtcccgaggcccgagggggcctccgtcccaccagcatgagcgaatgaaaggggagtttgcgtccggtggggtagatgagactctggttgagcagcaagtgcgtcttctgtcctcgtagagggttgagggggagagggagactggcactgttaggacggctctgggttttagagccagggaaagcgtggtaacgggctgggccgcgacccctagttgaaaagctctgtcttctgcaggcatcctgtcggctcacaagataatagccagctccccagaaatgaacctgcccacggtgtccgcgctcagggtaggtggagccgggcggagtgggaagcgggtggaggcccaggaaaaggatgacctgagatgaagtgagtctggccggcccctgcgcccaagtgctggtctttggccggcggtgacctttactccaggaacgtgacaatctttccaccttctcttgggcagctcaatgtggtgggaacacccagggagacataactgggggtcagatccagacactggagtggtagaggattaactgaggtgattatgtgatgaaagcacctggcacatagtaggtacctaataaatactcattttttaaattttttttcagacagggtcttactctgtcgcccaagctggagtgcagtggcgcgatctcagctcactgtaacctccgcctcccacctcagcctcccacctcagcctcccgagtagctggaattacaggcatccaccacgcgcagctaatttttgtatttttggtagagaatactgttggccaggctggtctcgaactcctggcctcaagtgatctgcccgccttggcctcccaaagtgctgggattacaggggtgagccactgcgctcagccatttttcttaatagacgagttgtatgaccttaaagtactcagccactttgaggctatttcctcatttacaacagtggccactttgctgttattctgagtcgtgaatgagcatattgggaagaatctggtgagttagttgttctgttctccaaaaacatattccaagtcttcacccaaaacctgtgctctgtgggagaggatggctgatgaggcaggtgacaggcagtgtctgtgcctagggtgggctgatgtccctagcactggagggtcctgcttctcagtttggagtcatagagggatggatggcttccagcctagccctggaccacatggagactgtgcggtccccacgaacaagcggccagggttaggatagggcctgactcagctgtgcttttaacgaccaggtattagcatttccctttgccctgccactttcaccatagggccttcttacctggcagaggagtgccttagataccagaagattggcagggaagaagggcagccacttcctggttaccatggagaagcttgtcatgctccaagcctgtgcttacttgtccagtagcaacaatgggaaactgtattatttggggtaggggtagaaccctgagggcataaagctaagaattccaggctgcatctggcagaatcggtttggcaggggttcagctgctccctgggaggccttggcatagccaggctgctccagcactgtgagctgggagtctcctcttgcagaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatgcattcatggctctggacgcattggctgatggtggggtgaagatgggtttgccacggcgcctggcaatccaactcggggcccaggctttgctgggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatctgtcccctctgtgattcagagcccttagttgagagcccctgccgcccctgccacccccctgccccgctcccaccattgcccctcctcagctgtgcaaggagaaagcatgcttaggaagttttcaggtccttgtgataaaacctccttaaatctgttcagaccaagcaatgcgagcttcctctcctgtcccatgttggaagttgctctgaaggggtggtagatgctggaagccagacacaaccctgcgtacgctgctcagttggtggagactggggctgggactggagtcagcccagctgggaggaggggctggggaggatctgcagctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaatatc

SEQ ID NO: 320331 - DNA, 2008 bp, Homo sapiens
ctaaggcgccatcagccgcccgggagatatccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcaagcgcgtggaggcgggaggcggcttcgcgggcggtcccgaggcccgagggggcctccgtcccaccagcatgagcgaatgaaaggggagtttgcgtccggtggggtagatgagactctggttgagcagcaagtgcgtcttctgtcctcgtagagggttgagggggagagggagactggcactgttaggacggctctgggttttagagccagggaaagcgtggtaacgggctgggccgcgacccctagttgaaaagctctgtcttctgcaggcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatgcattcatggctctggacgcattggctgatggtggggtgaagatgggtttgccacggcgcctggcaatccaactcggggcccaggctttgctgggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatctgtcccctctgtgattcagagcccttagttgagagcccctgccgcccctgccacccccctgccccgctcccaccattgcccctcctcagctgtgcaaggagaaagcatgcttaggaagttttcaggtccttgtgataaaacctccttaaatctgttcagaccaagcaatgcgagcttcctctcctgtcccatgttggaagttgctctgaaggggtggtagatgctggaagccagacacaaccctgcgtacgctgctcagttggtggagactggggctgggactggagtcagcccagctgggaggaggggctggggaggatctgcagctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaatatc

SEQ ID NO: 320332 - DNA, 1643 bp, Homo sapiens
ctaaggcgccatcagccgcccgggagatatccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatctgtcccctctgtgattcagagcccttagttgagagcccctgccgcccctgccacccccctgccccgctcccaccattgcccctcctcagctgtgcaaggagaaagcatgcttaggaagttttcaggtccttgtgataaaacctccttaaatctgttcagaccaagcaatgcgagcttcctctcctgtcccatgttggaagttgctctgaaggggtggtagatgctggaagccagacacaaccctgcgtacgctgctcagttggtggagactggggctgggactggagtcagcccagctgggaggaggggctggggaggatctgcagctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaatatc

SEQ ID NO: 320333 - DNA, 622 bp, Homo sapiens
ctaaggcgccatcagccgcccgggagatatccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacaaacccccatggctggcgcttaaaggtttggccccaaggggggcaaaaagggggc

SEQ ID NO: 320334 - DNA, 302 bp, Homo sapiens
actgccttctgagttattatagtggcttatacattttatggtttctagaatctttttgagtgagaatcattgagaatatttgtgtttttaatctcttctgtttatctcttctgttgatgtgctttttgttaattatttggctggcttttagtggatcttgcacaatttaatgctggcacatgataagttcataataaatgtttctgattatcgagctgagccccagtcatgaaccattgatttctaacatactctctccctttagcaacctggttacctctgcccttaaatgaacataaccc

SEQ ID NO: 320335 - DNA, 276 bp, Homo sapiens
ttcgagttccacagtgaagctggtctgaccatagtcacagagacaataaaccctaaagacttatgatcagcatccctcttgaaagctcatcttatctttccatactttttcaattcaaacctataccttgaaatgtcttgataggctccagaatccaagaataccaggcctctatcttataaattaaaatagcattaaggccatacctccctttctctcttctgacacatattctttttttttttttgagacagagtctcactatatcgcccagga

SEQ ID NO: 320336 - DNA, 535 bp, Homo sapiens
cacgtgccaccacacctggctgatttttgtatttttagtagagacggggtttcaccatgttggccaggctggtctcgaactcctgacctcaggtgatccacctgcctctgcctcccagagtgctgggattacaggcgtgagccaccacactcagccaacagcttcttactgagtgcttcctgtgtgccaagcaccagggatccaactgggtctcaatagggtgtgaagaagttatgcttttattttctacttaagtttctacctatatcatgccaatttccaaaaattcccttgagaaattagttcaagaaagtgctagacacgtgtagggagcctagattcacaggtggttggaggggggttgggtggtggaaggcaggtcctgggaagctccaggctgttgacctgcacccacctggttcacctgtggctctggttcccattgagctactcctccacactcaggaaggacaggtcttcagagtgtccaaatggtttgacacacatcccatacatgatggagggggccctgagg

SEQ ID NO: 320337 - DNA, 672 bp, Homo sapiens
catctcacgtccagggatgaatttagcaagctctgtaatgaccccggggttcctgaagccacagagggagcacaggtgagggcatccaagtgcaaatgagccctctggggaggcctgcttgagctgacacataaatggggttgaagccattgtgagcccatgggcacgggccaggcagggtggtgagagctccagacagggcgggctgggctcaggctgtgtccacccagggaaccagtgtcatgggcccaacataactcgtggtcagtttctgtgagggctgcttcaaagcaggggcccaaggctctgttaggggctttctgccacccaaaatgcactttccttcttttgttctctccccaacactcagaactgtccacaccaccttgagattctctatgtattttattttaaatttttattttttgagacagggtctagctagtcccccaggctggagtgcagagagaggctgtctcaagaaagaaagaaaggaaagataagaaagaaagcaatcaagatcacaagaactttcaacagcttagattttaaagtgcattaacaatttcctagacctaagtgacgcttcagtgtacagctagtatacatggaatgtcattcccacctgtatgttgagggacatgtatcccgtactccgaggcgtaccgcctg

SEQ ID NO: 320338 - DNA, 2151 bp, Homo sapiens
catctcacgtccagggatgaatttagcaagctctgtaatgaccccggggttcctgaagccacagagggagcacaggtgagggcatccaagtgcaaatgagccctctggggaggcctgcttgagctgacacataaatggggttgaagccattgtgagcccatgggcacgggccaggcagggtggtgagagctccagacagggcgggctgggctcaggctgtgtccacccagggaaccagtgtcatgggcccaacataactcgtggtcagtttctgtgagggctgcttcaaagcaggggcccaaggctctgttaggggctttctgccacccaaaatgcactttccttcttttgttctctccccaacactcagaactgtccacaccaccttgagattctctatgtattttattttaaatttttattttttgagacagggtctagctagtcccccaggctggagtgcagtggcacaaccatagctcactgcagcctccgtctcctgggctcaagagatcctccagcctcagcctctggagtagctgggactacaggtgcatgctaccatgcgctgctaatttttaaaaattatttgtagagatggggtcttgctctgttgcccaggctggtctcaaactcctgggctcaagtgatcctcccaccttggcctccctaagtgttggaattacaggtgtgagccactgtgcccgacctgccaagtatttgaattttatacacaggacctgtatcatgatcccatgctcagctgaaccaccctccaaaggatgcccatgtccccattcccggatcctgtgaatgttacctcatgtggcaaaggaaggactttgctgacgggattaaattgaggtggaaggcctccctggatcatccaggtgggttctacgtgtcatcccaaaggtcctcataagagaggggcaaagtgaggcttgaccacacagagaagccacatggccactgaggcggctgctggagctaagcacagggatgcctgggccacccagagctgggagaggcaggtaggatactcccctagcgcctccaccaggcaggcttccgctctccagggctgagagagaatagactgctgttgttttgagccagcaagcgtgaggtcgttagttccagcgcccacaggaaacgaacatacagtcatgcaccacataaccttcggtcaacaagcaatgccacagtgctcccatatcacagcgcggtatttttactgcacctgttctatgtttagatggctttagatacacaaataccagtgagtcacagctgcctacgctattcagcacagtcacctgccgcgtaggctcgtggccctggagcagcaggctgtgacacacagcctcggcgtgtagcaggctgtgccaccagggccagtgtgtgcactctgtgttcacacaaggacaaaatcacctaaggacgcatttctcagaaggaatgtatccttttcgttaaacaatgtatgactgttccccgaagagaaaagatcttccttggaccagaagttgagctctcagcatcagcggacgcccatgctgtcaaacgcaggttgctgtgccagaccccaaaaggacccgggcctggaggtgcatcaaggtggagatcagaagacccccacgccctcgaaacggcagagcagggcggcctggggctaggggcatcaggcagctgcttcctgcttaagcactacgactcgcacccagagcctcgaactccaggctgcacaaatacgattcctgcttggttcccagttggccctggacgctgccaaggggccctctctccacacccctagaacaaaagcctatcctgccggcccaagaaacagtcacggttgagggggaaaacgaaaaccttcctttgactacaggaaacttcccaaaggtttccctgtttcttcatctaaacccatctaagtgttgtgacacatgtgccggtgtgctgtgtgcgttcacttacaacagccccattcatgtatatgtcacacgtcaggggatgcaggcaccaaggggctaaggaactttctggggtcacacagctccggagttgggatctgaaccagccaccgcttaccgtggtctccgaggttcctgggctggtcctggcaccctcccccgcggccgcctc

SEQ ID NO: 320339 - DNA, 473 bp, Homo sapiens
aattaaggaggggagaagggggtacagtggggtatgaaggaggagagtcatcataggtagtgttcaggtatgtatatactctagttttggatacatgacaataattttctttttaagcaaaggcaatgtcaaaaagaggttgcaaagacctgctggaaaaaggagaaaagttttgcttcatgaaaaggtccatggagtcaatctttacttactctcgagctcttcctggagagtgaattctttactttaggcgctcgatgctcagtaaattgtgaaactcttccccctctgcgtataggcattagagacttttggagatgcatccagaatttatcaaactcctcagcaatcaaataatgataaattacatggttgctttagtgcctcgatggccttgtaagacaactgggggaaacagagactaacgtgcccagctagactaagaacttcattagagcaacacggctattttc

SEQ ID NO: 320340 - DNA, 381 bp, Homo sapiens
catgttgcccaggctggtctggaactcctgagctcaagcaatctgcttgcctctggcctcccaaagtgctgggaatacaggtgtaagtcactgcacccagcctggaatgtttttgaaaatgtatttttatatttttgtttttaacagtagtattgaggtatagggacagggacacacacacacacacacacacacacacacagagacacacacatccatccctccacagagtgcaatttgtgttaagttttaacttatgtgattatctgtgaaaccattaccacaaccaagattatgagcagatcaggacatcagaaggggcaggagggaaggattatcaaagactgtgaagaagcttttgggtgacagatttgttgtcac

SEQ ID NO: 320341 - DNA, 479 bp, Homo sapiens
tcctccctcacacactacactgaccatcaaatgctgctgtgtgccccttcggtgtgccccttcccctaagccctagtctcagaccagcacagcctgccttcttcatatcagattcatcacagagttgatggtaaactaaatgtagagcaaacaaaaagtaaagaatttccttttcccttgacattctcctccaatggctctccactgactacaaggtaaatcccaaatccttagcaagccaatgagatcctcccattttcaagtctctccttccctcccagactagagccaccaaaagcagcagtgaactgggatgctcttgacttgaggtctgatgctccatctagcggtagagaacatcgccttgggatgggactgagaaacacgccaggtcagacgctgggagagccaacaacctgccaagatgagagtttgtcacctctagtcagatttggaaggcaccgcaaaggtgaattcca

SEQ ID NO: 320342 - DNA, 406 bp, Homo sapiens
catacgtgggacaaggcaaagtaatgaagagacgggtggttgtgtagggcacctatggggacaggagcagagatttaacgacgagaggaaatagaggacggagcaagaagaataccccaagccagtgacacagaactttgtattgatcatgtgaccagctcatatcctgagcagttgctatctaggatgccctatcactagctcctagtgtataaggaccctatgaggtaggtaccatcatcacctccagttcacagatgaagaactaactcccccaagatcagacagttcacaagtgatggggccataatagcaacatcagcaatgagctgaacaagacaaacaaggcctgtgtcctcccggggcacacagacagatggggagacagacctacagcaagcaaaga

SEQ ID NO: 320343 - DNA, 624 bp, Homo sapiens
ttaatacaatgcctaaaagataattttattgaaaatatattgggtatgtttgagaagatggctttccaggttctcgcatgactgctgtagcatgtatgcccccagatgtgtcatttgtccctgaacaaggccaagtgagatcttcaaggacagcaggcaaaattccctttagctttcaagcgtctgatccagccttcaaatcctacacctaacgatgctctcttccaaagggccccttatctgtgttttcggctaacaagcggtggacgcctcctcgaagcatccgcttcactgcagaagaaggggacttggggttcaccttgagagggaacgcccccgttcaggttcacttcctggatccttactgctctgcctcggtggcaggagcccgggaaggagattatattgtctccattcagcttgtggattgtaagtggctgacgctgagtgaggttatgaagctgctgaagagctttggcgaggacgagatcgagatgaaagtcgtgagcctcctggactccacatcatccatggtgagcgccttcaccttcttgagcagcccccagtggagtggagttaatggtgaaagaggtctcctgctgaagagtgacggacagtgaatct

SEQ ID NO: 320344 - DNA, 2900 bp, Homo sapiens
ccgcgcctcagtccgccgtccgccctccgcgcccgcgccgctagcatgaccgacgcgctgttgcccgcggccccccagccgctggagaaggagaacgacggctactttcggaagggctgtaatccccttgcacaaaccggccggagtaaattgcagaatcaaagagctgctttgaatcagcagatcctgaaagccgtgcggatgaggaccggagcggaaaaccttctgaaagtggccacaaactcaaaggtgcgggagcaagtgcggctggagctgagcttcgtcaactcagacctgcagatgctcaaggaagagctggaggggctgaacatctcggtgggcgtctatcagaacacagaggaggcatttacgattcccctgattcctcttggcctgaaggaaacgaaagacgtcgactttgcagtcgtcctcaaggattttatcctggaacattacagtgaagatggctatttatatgaagatgaaattgcagatcttatggatctgagacaagcttgtcggacgcctagccgggatgaggccggggtggaactgctgatgacatacttcatccagctgggctttgtcgagagtcgattcttcccgcccacacggcagatgggactcctgttcacctggtatgactctctcaccggggttccggtcagccagcagaacctgctgctggagaaggccagtgtcctgttcaacactggggccctctacacccagattgggacccggtgtgatcggcagacgcaggctgggctggagagtgccatagatgcctttcagagagccgcaggggttttaaattacctgaaagacacatttacccatactccaagttacgacatgagccctgccatgctcagcgtgctcgtcaaaatgatgcttgcacaagcccaagaaagcgtgtttgagaaaatcagccttcctgggatccggaatgaattcttcatgctggtgaaggtggctcaggaggctgctaaggtgggagaggtctaccaacagctacacgcagccatgagccaggcgccggtgaaagagaacatcccctacttctgggccagcttagcctgcgtgaaggcccaccactacgcggccctggcccactacttcactgccatcctcctcatcgaccaccaggtgaagccaggcacggatctggaccaccaggagaagtgcctgtcccagctctacgaccacatgccagaggggctgacacccttggccacactgaagaatgatcagcagcgccgacagctggggaagtccacttgcgcagagccatggctcatcacgaggagtcggtgcgggaggccagcctctgcaagaagctgcggagcgattgaggtgctacagaaggtgctgtgtgccgcacaggaacgctcccggctcacgtacgcccagcaccaggaggaggatgacctgctgaacctgatcgacgcccccagtgttgttgctaaaactgagcaagaggttgacattatattgccccagttctccaagctgacagtcacggacttcttccagaagctgggccccttatctgtgttttcggctaacaagcggtggacgcctcctcgaagcatccgcttcactgcagaagaaggggacttggggttcaccttgagagggaacgcccccgttcaggttcacttcctggatccttactgctctgcctcggtggcaggagcccgggaaggagattatattgtctccattcagcttgtggattgtaagtggctgacgctgagtgaggttatgaagctgctgaagagctttggcgaggacgagatcgagatgaaagtcgtgagcctcctggactccacatcatccatgcataataagagtgccacatactccgtgggaatgcagaaaacgtactccatgatctgcttagccattgatgatgacgacaaaactgataaaaccaagaaaatctccaagaagctttccttcctgagttggggcaccaacaaagaacagacagaagtcagccagcaccttgtgcctcccatcggtcggggctgcacggcctcaggtcaagaagaagctgccctcccctttcagccttctcaactcagacagttcttggtactaatgtgaggaaacaaacatgttcaggccctgaacatttccggtgctgactcggccttaaacgtttgtgccataatggaaaatatctatctatctgttctcaaatcctgtttttctcatagtgtaaactcacatttgatgtgtttttatgaaggaaagtaaccaagaaacctctaggaattagtgaaaaaagaacttttttgaggtgtgttactatactgctgtaagttatttattatataaagtattgtaaatagaatagtgttgaagatatgaaatatggctatttttaatggtgacaattatgacttttagtcactattaaattggggttacctatatcagtacaatttgtagttgtttccaggtttggctaataatcattccttaacctagaattcagatgatcctggaattaaggcaggtcagaggactgtaatgatagaattaaattagtgtcactaaaaactgtcccaaatgctgggattacaggcatgagccaccacaaccgtcccactattttactttttaaaatgacattcctactgattgatttttatcttgctataagttcgatgacaccgtgaatctaataaggttcactgttgacacagtacaagttacatagctaaaatacatagcattgaagactaattttaaggattgacaagagtttattttctattgtgcaatatcttaaaggaagcaaccacctttgggaaagtgtatctgctgctcctagggccatgcttgtatacatatttaaataaacatattcatttacccgaaaaaatatt

SEQ ID NO: 320345 - DNA, 1915 bp, Homo sapiens
gcgcgatcttggttcactgcaacctccacctcctgggttcaagtaattctcctgcctcaggctgctgagtagctgggattacaggtggcaggagcccgggaaggagattatattgtctccattcagcttgtggattgtaagtggctgacgctgagtgaggttatgaagctgctgaagagctttggcgaggacgagatcgagatgaaagtcgtgagcctcctggactccacatcatccatgcataataagagtgccacatactccgtgggaatgcagaaaacgtactccatgatctgcttagccattgatgatgacgacaaaactgataaaaccaagaaaatctccaagaagctttccttcctgagttggggcaccaacaaagaacagacagaagtcagccagcaccttgtgcctcccatcggtcggggctgcacggcctcaggtcaagaagaagctgccctcccctttcagccttctcaactcagacagttcttggtactaatgtgaggaaacaaacatgttcaggccctgaacatttccggtgctgactcggccttaaacgtttgtgccataatggaaaatatctatctatctgttctcaaatcctgtttttctcatagtgtaaactcacatttgatgtgtttttatgaaggaaagtaaccaagaaacctctaggaattagtgaaaaaagaacttttttgaggtgtgttactatactgctgtaagttatttattatataaagtattgtaaatagaatagtgttgaagatatgaaatatggctatttttaatggtgacaattatgacttttagtcactattaaattggggttacctatatcagtacaatttgtagttgtttccaggtttggctaataatcattccttaacctagaattcagatgatcctggaattaaggcaggtcagaggactgtaatgatagaattaaattagtgtcactaaaaactgtcccaaagtgctgcttcctaataggaattcattaacctaaaacaagatgttactattatatcgatagactatgaatgctatttctagaaaaagtctagtgccaaatttgtcttattaaataaaaacaatgtaggagcagcttttcttctagtttgatgtcatttaagaattactaacacagtggcagtgttagatgaagatgctgtctacaaggtagataatatactgtttgatactcaaaacatttttcattttgtttaaagtagaagttacataattctatattttaagtcttgggtaaaaaagtagttttacattttataaagtaaagatgtaaatgattcaggtttaaagctctatttgacttcctttttttgtttgagatagcgtcttgctgtgttgcccaggctggagtgcagtggtgtgatctcagctcagtgcaacctccgccccctgggatcaagcgattctcctacctcagcctcccaaatagctgggactacaaggtgccctccagcatgcctggctgatttttgtatttttagttgaggtgaggtttcaccatgttggccaggcgggtttcgaaatcctgacctcaaatgatccacccacctcagcctcccaaagtgctgggattacaggcatgagccaccacaaccgtcccactattttactttttaaaatgacattcctactgattgatttttatcttgctataagttcgatgacaccgtgaatctaataaggttcactgttgacacagtacaagttacatagctaaaatacatagcattgaagactaattttaaggattgacaagagtttattttctattgtgcaatatcttaaaggaagcaaccacctttgggaaagtgtatctgctgctcctagggccatgcttgtatacatatttaaataaacatattcatttacccgaaaaaatatt

SEQ ID NO: 320346 - DNA, 803 bp, Homo sapiens
ccgcgcctcagtccgccgtccgccctccgcgcccgcgccgctagcatgaccgacgcgctgttgcccgcggccccccagccgctggagaaggagaacgacggctactttcggaagggctgtaatccccttgcacaaaccggccggagtaaattgcagaatcaaagagctgctttgaatcagcagatcctgaaagccgtgcggatgaggaccggagcggaaaaccttctgaaagtggccacaaactcaaaggtgcgggagcaagtgcggctggagctgagcttcgtcaactcagacctgcagatgctcaaggaagagctggaggggctgaacatctcggtgggcgtctatcagaacacagaggaggcatttacgattcccctgattcctcttggcctgaaggaaacgaaagacgtcgactttgcagtcgtcctcaaggttggtttgaaggtaattgcagtttttccattgaaagtaatggctaaagtgctgggattacaggcatgagccaccacaaccgtcccactattttactttttaaaatgacattcctactgattgatttttatcttgctataagttcgatgacaccgtgaatctaataaggttcactgttgacacagtacaagttacatagctaaaatacatagcattgaagactaattttaaggattgacaagagtttattttctattgtgcaatatcttaaaggaagcaaccacctttgggaaagtgtatctgctgctcctagggccatgcttgtatacatatttaaataaacatattcatttacccgaaaaaatatt

SEQ ID NO: 320347 - DNA, 218 bp, Homo sapiens
cacccaaagtgaatttttgctttcttgatgcgaacttacgcaaatacctattttgttaatggggactgattcaaggatttgagtgaacaaaacgttgacttaatttcaacaatactttttcaggtggcaggagcccgggaaggagattatattgtctccattcagcttgtggattgtaagtggctgacgctgagtgaggttatgaagctgctgaagag

SEQ ID NO: 320348 - DNA, 3520 bp, Homo sapiens
ccgcgcctcagtccgccgtccgccctccgcgcccgcgccgctagcatgaccgacgcgctgttgcccgcggccccccagccgctggagaaggagaacgacggctactttcggaagggctgtaatccccttgcacaaaccggccggagtaaattgcagaatcaaagagctgctttgaatcagcagatcctgaaagccgtgcggatgaggaccggagcggaaaaccttctgaaagtggccacaaactcaaaggtgcgggagcaagtgcggctggagctgagcttcgtcaactcagacctgcagatgctcaaggaagagctggaggggctgaacatctcggtgggcgtctatcagaacacagaggaggcatttacgattcccctgattcctcttggcctgaaggaaacgaaagacgtcgactttgcagtcgtcctcaaggattttatcctggaacattacagtgaagatggctatttatatgaagatgaaattgcagatcttatggatctgagacaagcttgtcggacgcctagccgggatgaggccggggtggaactgctgatgacatacttcatccagctgggctttgtcgagagtcgattcttcccgcccacacggcagatgggactcctgttcacctggtatgactctctcaccggggttccggtcagccagcagaacctgctgctggagaaggccagtgtcctgttcaacactggggccctctacacccagattgggacccggtgtgatcggcagacgcaggctgggctggagagtgccatagatgcctttcagagagccgcaggggttttaaattacctgaaagacacatttacccatactccaagttacgacatgagccctgccatgctcagcgtgctcgtcaaaatgatgcttgcacaagcccaagaaagcgtgtttgagaaaatcagccttcctgggatccggaatgaattcttcatgctggtgaaggtggctcaggaggctgctaaggtgggagaggtctaccaacagctacacgcagccatgagccaggcgccggtgaaagagaacatcccctacttctgggccagcttagcctgcgtgaaggcccaccactacgcggccctggcccactacttcactgccatcctcctcatcgaccaccaggtgaagccaggcacggatctggaccaccaggagaagtgcctgtcccagctctacgaccacatgccagaggggctgacacccttggccacactgaagaatgatcagcagcgccgacagctggggaagtccacttgcgcagagccatggctcatcacgaggagtcggtgcgggaggccagcctctgcaagaagctgcggagcgattgaggtgctacagaaggtgctgtgtgccgcacaggaacgctcccggctcacgtacgcccagcaccaggaggaggatgacctgctgaacctgatcgacgcccccagtgttgttgctaaaactgagcaagaggttgacattatattgccccagttctccaagctgacagtcacggacttcttccagaagctgggccccttatctgtgttttcggctaacaagcggtggacgcctcctcgaagcatccgcttcactgcagaagaaggggacttggggttcaccttgagagggaacgcccccgttcaggttcacttcctggatccttactgctctgcctcggtggcaggagcccgggaaggagattatattgtctccattcagcttgtggattgtaagtggctgacgctgagtgaggttatgaagctgctgaagagctttggcgaggacgagatcgagatgaaagtcgtgagcctcctggactccacatcatccatgcataataagagtgccacatactccgtgggaatgcagaaaacgtactccatgatctgcttagccattgatgatgacgacaaaactgataaaaccaagaaaatctccaagaagctttccttcctgagttggggcaccaacaaagaacagacagaagtcagccagcaccttgtgcctcccatcggtcggggctgcacggcctcaggtcaagaagaagctgccctcccctttcagccttctcaactcagacagttcttggtactaatgtgaggaaacaaacatgttcaggccctgaacatttccggtgctgactcggccttaaacgtttgtgccataatggaaaatatctatctatctgttctcaaatcctgtttttctcatagtgtaaactcacatttgatgtgtttttatgaaggaaagtaaccaagaaacctctaggaattagtgaaaaaagaacttttttgaggtgtgttactatactgctgtaagttatttattatataaagtattgtaaatagaatagtgttgaagatatgaaatatggctatttttaatggtgacaattatgacttttagtcactattaaattggggttacctatatcagtacaatttgtagttgtttccaggtttggctaataatcattccttaacctagaattcagatgatcctggaattaaggcaggtcagaggactgtaatgatagaattaaattagtgtcactaaaaactgtcccaaagtgctgcttcctaataggaattcattaacctaaaacaagatgttactattatatcgatagactatgaatgctatttctagaaaaagtctagtgccaaatttgtcttattaaataaaaacaatgtaggagcagcttttcttctagtttgatgtcatttaagaattactaacacagtggcagtgttagatgaagatgctgtctacaaggtagataatatactgtttgatactcaaaacatttttcattttgtttaaagtagaagttacataattctatattttaagtcttgggtaaaaaagtagttttacattttataaagtaaagatgtaaatgattcaggtttaaagctctatttgacttcctttttttgtttgagatagcgtcttgctgtgttgcccaggctggagtgcagtggtgtgatctcagctcagtgcaacctccgccccctgggatcaagcgattctcctacctcagcctcccaaatagctgggactacaaggtgccctccagcatgcctggctgatttttgtatttttagttgaggtgaggtttcaccatgttggccaggcgggtttcgaaatcctgacctcaaatgatccacccacctcagcctcccaaagtgctgggattacaggcatgagccaccacaaccgtcccactattttactttttaaaatgacattcctactgattgatttttatcttgctataagttcgatgacaccgtgaatctaataaggttcactgttgacacagtacaagttacatagctaaaatacatagcattgaagactaattttaaggattgacaagagtttattttctattgtgcaatatcttaaaggaagcaaccacctttgggaaagtgtatctgctgctcctagggccatgcttgtatacatatttaaataaacatattcatttacccgaaaaaatatt

SEQ ID NO: 320349 - DNA, 2208 bp, Homo sapiens
ttaatacaatgcctaaaagataattttattgaaaatatattgggtatgtttgagaagatggctttccaggttctcgcatgactgctgtagcatgtatgcccccagatgtgtcatttgtccctgaacaaggccaagtgagatcttcaaggacagcaggcaaaattccctttagctttcaagcgtctgatccagccttcaaatcctacacctaacgatgctctcttccaaagggccccttatctgtgttttcggctaacaagcggtggacgcctcctcgaagcatccgcttcactgcagaagaaggggacttggggttcaccttgagagggaacgcccccgttcaggttcacttcctggatccttactgctctgcctcggtggcaggagcccgggaaggagattatattgtctccattcagcttgtggattgtaagtggctgacgctgagtgaggttatgaagctgctgaagagctttggcgaggacgagatcgagatgaaagtcgtgagcctcctggactccacatcatccatgcataataagagtgccacatactccgtgggaatgcagaaaacgtactccatgatctgcttagccattgatgatgacgacaaaactgataaaaccaagaaaatctccaagaagctttccttcctgagttggggcaccaacaaagaacagacagaagtcagccagcaccttgtgcctcccatcggtcggggctgcacggcctcaggtcaagaagaagctgccctcccctttcagccttctcaactcagacagttcttggtactaatgtgaggaaacaaacatgttcaggccctgaacatttccggtgctgactcggccttaaacgtttgtgccataatggaaaatatctatctatctgttctcaaatcctgtttttctcatagtgtaaactcacatttgatgtgtttttatgaaggaaagtaaccaagaaacctctaggaattagtgaaaaaagaacttttttgaggtgtgttactatactgctgtaagttatttattatataaagtattgtaaatagaatagtgttgaagatatgaaatatggctatttttaatggtgacaattatgacttttagtcactattaaattggggttacctatatcagtacaatttgtagttgtttccaggtttggctaataatcattccttaacctagaattcagatgatcctggaattaaggcaggtcagaggactgtaatgatagaattaaattagtgtcactaaaaactgtcccaaagtgctgcttcctaataggaattcattaacctaaaacaagatgttactattatatcgatagactatgaatgctatttctagaaaaagtctagtgccaaatttgtcttattaaataaaaacaatgtaggagcagcttttcttctagtttgatgtcatttaagaattactaacacagtggcagtgttagatgaagatgctgtctacaaggtagataatatactgtttgatactcaaaacatttttcattttgtttaaagtagaagttacataattctatattttaagtcttgggtaaaaaagtagttttacattttataaagtaaagatgtaaatgattcaggtttaaagctctatttgacttcctttttttgtttgagatagcgtcttgctgtgttgcccaggctggagtgcagtggtgtgatctcagctcagtgcaacctccgccccctgggatcaagcgattctcctacctcagcctcccaaatagctgggactacaaggtgccctccagcatgcctggctgatttttgtatttttagttgaggtgaggtttcaccatgttggccaggcgggtttcgaaatcctgacctcaaatgatccacccacctcagcctcccaaagtgctgggattacaggcatgagccaccacaaccgtcccactattttactttttaaaatgacattcctactgattgatttttatcttgctataagttcgatgacaccgtgaatctaataaggttcactgttgacacagtacaagttacatagctaaaatacatagcattgaagactaattttaaggattgacaagagtttattttctattgtgcaatatcttaaaggaagcaaccacctttgggaaagtgtatctgctgctcctagggccatgcttgtatacatatttaaataaacatattcatttacccgaaaaaatatt

SEQ ID NO: 320350 - DNA, 1077 bp, Homo sapiens
ccgcgcctcagtccgccgtccgccctccgcgcccgcgccgctagcatgaccgacgcgctgttgcccgcggccccccagccgctggagaaggagaacgacggctactttcggaagggctgtaatccccttgcacaaaccggccggagtaaattgcagaatcaaagagctgctttgaatcagcagatcctgaaagccgtgcggatgaggaccggagcggaaaaccttctgaaagtggccacaaactcaaaggtgcgggagcaagtgcggctggagctgagcttcgtcaactcagacctgcagatgctcaaggaagagctggaggggctgaacatctcggtgggcgtctatcagaacacagaggaggcatttacgattcccctgattcctcttggcctgaaggaaacgaaagacgtcgactttgcagtcgtcctcaaggattttatcctggaacattacagtgaagatggctatttatatgaagatgaaattgcagatcttatggatctgagacaagcttgtcggacgcctagccgggatgaggccggggtggaactgctgatgacatacttcatccagctgggctttgtcgagagtcgattcttcccgcccacacggcagatgggactcctgttcacctggtatgactctctcaccggggttccggtcagccagcagaacctgctgctggagaaggccagtgtcctgttcaacactggggccctctacacccagattgggacccggtgtgatcggcagacgcaggctgggctggagagtgccatagatgcctttcagagagccgcaggtatgtctcctccagggctgaccagacggagccttggccccacccggtggcaccaggggaccccccactgaagagaatctacaggtcatccctcgcaagggccagaccagtctccagctctggtgtaacttcccattaagaaacttgctccggccgggcgcggtggctcacgcctgtaatcccagcacttcgggaggccaaagcgggtggatcacaaggtcaggagatcgaggccagactgcatctcaaaaaaaaaaaaaaaaacttgctcg

SEQ ID NO: 320351 - DNA, 576 bp, Homo sapiens
tcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtcctcagagtgcagaaccacagacggcttcggctgtgcctagggcaacagccaacctaggagccagcgggctttcggggaaaaaaaagaaaaagacatctaaaataaaatgtttaaactgtt

SEQ ID NO: 320352 - DNA, 434 bp, Homo sapiens
cttaggtttaactgaaatgcctactattttagtaactacacatttccagcaaaagtaaagaaatgatactcaatttgattattcaccacagacgccaagatcattctttagtctgattttagcctcacgtggtctcacccgaacatttgtttttggaatttggacctaactggttaccaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggtaaacagcttgggatttggggagtcattcttccattcatccattcaatccatggcagcaaacagagcaataaaatgcatgaattctggagcttga

SEQ ID NO: 320353 - DNA, 2336 bp, Homo sapiens
tcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttcaaaataattatcttgggaaaaatcagggttttgctggacttgcactaatttgtacagttaacttcgtactttgacacacacctgaagatgcctccacctttgtagggcttagggcctttttatcagccctgggtggaccccagggccccttcctttcccttcccttctggtcatttctctggacttgtagagaatgtcctaagaaagtgtgactcacagacctctggattccatgtgtccaattagcgctgatgggactggagaaaggcttaaatccaatgggatctgcctgtgttggcaatttagggccgagatggctcgagggagtagatgcagagaggaagggtgatgatccctctgtgaccaagacacaatcctgtcccttcttttagtcaggatatccctgatgacagacagtgggacaatcaccaggccccattgtttaataaaacgaggcttttgctcaggtcta

SEQ ID NO: 320354 - DNA, 2718 bp, Homo sapiens
tcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcaggtaaaggggaaggcgccacagttttccccagtcccattagctgccctcctgtcttccacccatctccatccttctctgcccttgaaacctggctcgagacatcttccctccccagagccttcccttagtgatctcaatttattcaggggcactattcccagagcatctcctccactccctaaggacaggtgcaggactgagagtccaggagggtgaggacccttctcctccactagaccacagcagaagccgagtcttctgtcctcatcttcacattgtactcaagtcaccttgcccctgggggtgcctataagaagtaataagtcacagatctctctttctatttctgcttccctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttcaaaataattatcttgggaaaaatcagggttttgctggacttgcactaatttgtacagttaacttcgtactttgacacacacctgaagatgcctccacctttgtagggcttagggcctttttatcagccctgggtggaccccagggccccttcctttcccttcccttctggtcatttctctggacttgtagagaatgtcctaagaaagtgtgactcacagacctctggattccatgtgtccaattagcgctgatgggactggagaaaggcttaaatccaatgggatctgcctgtgttggcaatttagggccgagatggctcgagggagtagatgcagagaggaagggtgatgatccctctgtgaccaagacacaatcctgtcccttcttttagtcaggatatccctgatgacagacagtgggacaatcaccaggccccattgtttaataaaacgaggcttttgctcaggtcta

SEQ ID NO: 320355 - DNA, 1484 bp, Homo sapiens
tcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcaggtaaaggggaaggcgccacagttttccccagtcccattagctgccctcctgtcttccacccatctccatccttctctgcccttgaaacctggctcgagacatcttccctccccagagccttcccttagtgatctcaatttattcaggggcactattcccagagcatctcctccactccctaaggacaggtgcaggactgagagtccaggagggtgaggacccttctcctccactagaccacagcagaagccgagtcttctgtcctcatcttcacattgtactcaagtcaccttgcccctgggggtgcctataagaagtaataagtcacagatctctctttctatttctgcttccctcagaaaacttggcgcatcatctggaaatagattcaggtaaacagcttgggatttggggagtcattcttccattcatccattcaatccatggcagcaaacagagcaataaaatgcatgaattctggagcttga

SEQ ID NO: 320356 - DNA, 1885 bp, Homo sapiens
tcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtt

SEQ ID NO: 320357 - DNA, 2359 bp, Homo sapiens
tcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttcaaaataattatcttgggaaaaatcagggttttgctggacttgcactaatttgtacagttaacttcgtactttgacacacacctgaagatgcctccacctttgtagggcttagggcctttttatcagccctgggtggaccccagggccccttcctttcccttcccttctggtcatttctctggacttgtagagaatgtcctaagaaagtgtgactcacagacctctggattccatgtgtccaattagcgctgatgggactggagaaaggcttaaatccaatgggatctgcctgtgttggcaatttagggccgagatggctcgagggagtagatgcagagaggaagggtgatgatccctctgtgaccaagacacaatcctgtcccttcttttagtcaggatatccctgatgacagacagtgggacaatcaccaggccccattgtttaataaaacgaggcttttgctcaggtcta

SEQ ID NO: 320358 - DNA, 1685 bp, Homo sapiens
tcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaacctcagagtgcagaaccacagacggcttcggctgtgcctagggcaacagccaacctaggagccagcgggctttcggggaaaaaaaagaaaaagacatctaaaataaaatgtttaaactgtttcaaaataattatcttgggaaaaatcagggttttgctggacttgcactaatttgtacagttaacttcgtactttgacacacacctgaagatgcctccacctttgtagggcttagggcctttttatcagccctgggtggaccccagggccccttcctttcccttcccttctggtcatttctctggacttgtagagaatgtcctaagaaagtgtgactcacagacctctggattccatgtgtccaattagcgctgatgggactggagaaaggcttaaatccaatgggatctgcctgtgttggcaatttagggccgagatggctcgagggagtagatgcagagaggaagggtgatgatccctctgtgaccaagacacaatcctgtcccttcttttagtcaggatatccctgatgacagacagtgggacaatcaccaggccccattgtttaataaaacgaggcttttgctcaggtcta

SEQ ID NO: 320359 - DNA, 1372 bp, Homo sapiens
tcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgcagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttcaaaataattatcttgggaaaaatcagggttttgctggacttgcactaatttgtacagttaacttcgtactttgacacacacctgaagatgcctccacctttgtagggcttagggcctttttatcagccctgggtggaccccagggccccttcctttcccttcccttctggtcatttctctggacttgtagagaatgtcctaagaaagtgtgactcacagacctctggattccatgtgtccaattagcgctgatgggactggagaaaggcttaaatccaatgggatctgcctgtgttggcaatttagggccgagatggctcgagggagtagatgcagagaggaagggtgatgatccctctgtgaccaagacacaatcctgtcccttcttttagtcaggatatccctgatgacagacagtgggacaatcaccaggccccattgtttaataaaacgaggcttttgctcaggtcta

SEQ ID NO: 320360 - DNA, 172 bp, Homo sapiens
tgggcagaagttatgagtaaagccgggtggagtcttgccatgggagtcaagagtccgctggatcacgcaggggtggggacatggtgatagggaagaaacctcccaggaccgacgggctgcaatgtgatcagtgccccacacaaaggactaaggtctatatcccagcagcccc

SEQ ID NO: 320361 - DNA, 531 bp, Homo sapiens
gagctactgtaggcctggcccaatacttggtacttttccatactgtaagcactttatttaacatcacgataatcctgaaagaagtacgtatttctttttctttcttttttttttttgagacaaggtcacccaggatagagtgcagtgatgcaatcatggctcgctgaagcctcgacctcctgggctcaagtcatcctccgatctcagccttctgtgtagctaggactacaggcctgtgccaccatgtctcgctattttttttggtattttttatagagatggcagggtctcaccatgttgtccaggctggtcttgaactcctgggctcaagtgatcctcctgcctcagcctcccaaagttctgggactacaagcatgagccactgtgcccagccaagaagtaaatatttctttcttttttaaaattatctcatgcaacagatgaaagaagtatatatttctttatctgcactttgtagttgaaagaaaccaagctcagagaggttaaatatcatttccaatgtcacagagc

SEQ ID NO: 320362 - DNA, 807 bp, Homo sapiens
gagctactgtaggcctggcccaatacttggtacttttccatactgtaagcactttatttaacatcacgataatcctgaaagaagtacgtatttctttttctttcttttttttttttgagacaaggtcacccaggatagagtgcagtgatgcaatcatggctcgctgaagcctcgacctcctgggctcaagtcatcctccgatctcagccttctgtgtagctaggaactagtgaaaacgatgactatgcacaagagtaagcaccattgtttttcggcacccccttttccatcgggtgcacgcaggcacgcggacacacaagcctctcccctgcccccgcgccccgcctgcgcggggaatctgccacacggtatgaactgtgctctcagcggagaaatactctggcccagcaatttatgtgtgttttgtttgttttaagtgggaaggaaaggaagagagtggggcgtgaaaatgggagatcagttttaactcagatttaattcaatggttcgcgtttcctcccatctttctctgcatcaaaatgcaggtagatcggtgaaatttcaagtttcttgggtcgttaaataccccaatttaaacgatggaggctgggaactggggatataaggaggaaacctagggttggaagggcgggcagggttaaagaggttcgggagctccgcagatctgagcgaagcatgcgaggctgccgcgcccgggcagcggctgcgtctcgggttctcgccctgcccgctgcctcgggtttttgccagtgactgcgccgtcttggctgcccacccacacctcgg

SEQ ID NO: 320363 - DNA, 810 bp, Homo sapiens
gagtttgctgactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcttaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctg

SEQ ID NO: 320364 - DNA, 909 bp, Homo sapiens
gagtttgctgactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaagtaccctcaggacctgcaggcccgtgcccgtgtggatgagtacctggcatggcagcacacgactctgcggagaagctgcctccgggccttgtggcataaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcttaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctg

SEQ ID NO: 320365 - DNA, 4380 bp, Homo sapiens
  misc_feature (327)..(327): n is a, c, g, or t
  misc_feature (967)..(967): n is a, c, g, or t
  misc_feature (4380)..(4380): n is a, c, g, or t
gagtttgctgactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaaggtaggtccagcctcgggtttggggaaccgaaaagtcaggaaggggacaggtaggcatacatagcttagggaacttctcccagcgccaccttcttcctggggccattgctggtctggtttggagaccgaacagagaaaggtgagccagcagggagatccaagagtcngggctccccaaaactctgctcggtctcacggaatagaccacggggttcccctgaggccgaataaaggggtggggatcatgaagagaagccagacaggaggacaaaaacgggcgcagctgggtgcaggggcacacgcctgtagtcccagcaactcgagaggctggggtgggaggatcgcttgagcccaggaattccaggccgcagtgcactatcatggtgcccttgaatagccactgcactcccgtcagggcaatctagcgagaccccgtcttaaaaaaaaaaaacaaaaaaaaacaaaatgaaagcaggtgtgacctcggcctagggaaaggtgggatgagagaggtcaagggtgccaagtgtagagactgggacagcgtcaagtcccttctttatggcccagctgctgagattctgcaacagcaaacagctcaggacgtgactttccatccctgccctctgcactcgtccagtctgcattggggtccctctttgtcccttccttcctctgttcctcctgttttgcctctgaccttgtccttgtccttttttttttgagacagagtcttgcttttgctttgttgcagtgcagtggcacggatctcgaatcactgcaaccaccacctcccgggttcaagcnattctcctgcttcagcctcctgagtagctagattacaaatgtgtgccactatgtctggctaatttttttgtatttttaacagagatgggatttcacaattttggtcaggctgttctcgaactcctgacatcaaatgatctgccggcttagcctcccaaagtgctgggattacaggcatgagccactgtgcctggcccaaggcattttgtttatttgtttgtttgtttttgagacggagtctcgctctgtcgcccaggctggagtgcagtggcaggatcacagctcactgcaacctctgccgcccgaaaccttgtcctctgcctcttgttcctgctggggaggtaggttgccccaggctgctgatgctggaagcagcagggggaccctggggcttgatgagccctacaccctgttttgtttctctagcatgcctccaaggcccttgaggactcagctggcaggcccaggcccaggcccagtgcagggtggggtagtaggaggggttggaagcagaatccaggtatggctggtggggcaagtaaggcgactctacttggctaagccttctgcccagggctcccactccatggctggccctctgcctgaaacttctccacataatctcttctgcaaactgcccactgtcctgcgcaaggacttcctctgcagagtgtggagtagaggaaagggaatgggggacaagaggacgtccaagctggttgtcaaatgtagtggtgcagagggaagtgtgttttcccaggagacagaggagggttttcctggtgaaggaacagtctgaagggagggtgaagagagggtagcaggctgggcatggtggctcacacctgtaatcccagcactttgggaggccgaagtaggaagattacttgaggccagtagttcaagaccagcctgggcaacatagtgagaccccaactgtaaggggaataaaagtttggggcacagggggtggtagcaggtatgctacacacagctccacagtgcccagggcagggtgaacaaagggacatggtggggccagtagaagttgcttctaagtaggtagataccagaaaaagaccacttctctgtgtttcatgaccctgccttagaattaatggtggaagggacaaggtagtcagtcccctcaggtgacctatcgtgcagcttggggtgctctgattgtgagttcatgaagctggcaatagtggaaagaggagatgggtagggtgcatgcaaaggtccaggaaccacaccctgcacagtgagctctgttgcagaggggcagcctgtgggaggaggctgtgcctacaggacttagcaaggggtgttgtctattttgtaccagccggtggagtggtctcctcctcctcccgcaggggcccttccagtctttgccaaccaggagtgcagactggtgggaagaagaactgtgaaactggggccagagcattgcagggaggggcacaggccatggcgggctcagcgttctcctcccaccacccaccatgctggactcttcccaggtcagcacttaagcgatgcctttgcccaggtgaaccccctcaagaaggtgccagccttgaaggacggggacttcaccttgacggagaggtaactgggaccctaggactgctgccaggcctgctggaaccatcctgttctaaccctctatttcatagacaaggaaactaaagtcttcagaggcagagagtctctgtgccccgcatcctgcagagagtcagtactggaccccaggcccttgccttcctgctattccagttcaccctgatgattagaaaagcaaatatctactttacttccacaccagtgctttggttgctggtgagtggtgagagtatccttgagacagggtaggccagaggacgatggcagctttgcccaccatggggcaggcctctggccaagcttgtgtggcgatggctcagtggcatctgggctgcccggtggctccatctctgggctgcagcttcccaggatgggtcttccccatggaagagccaccagatatggacgtcttacatcacagctggtcccaagaagttgaatcctcttcaggaaaagccaatctttccccagttctgccccttttgtcaccagagtcacccttcccctaacaagaacctggagtttgtgctttaaagctcatctctgaaatctcaggatggacgcacctccgatgaattcctctgacattctgccagggcccttcttcctccctggtgccccaggtgtcctgagtccttgtgtcactcagcgttgtgacccccaggtaccagccagagtcaatgtgcaatctctgcctctgtcactactctcaccttcaggtctgtggctcacagagacctgcagccctcctcagaggtggcttgaacaattggctgggagcaaaaggagctcctgggcaccctgcacagacaacggagtcgttaagctgggacacgtgtgtagccccagcttaaaagagaatataggcccgtggcagatacagaggttttctgcccttttggcctgcatgcccaacctttgggaaaccccaagttcctgaaagcttttctgtgtctccaaatggacacatcctgtgtccttccaggtccatgctcatctcatcaccatggcggccctcaaaacccagggaaggaggagagtgccagggggccttgtctgttctgttgttctaggatcctgcagctgcaggagtgcttcctgagtggtactttaggaagccaaactaccccagtcagcttagataggagctgattcttggcagaaagaatgacagaaagaacaaagggacacggaagcctttttgaacagtcaggccatcagaggctggtcggaatcccagcagatgagagtggataccgaatggaaagaactgagcttctttaaagctcagctttgatgccccgttctccctggaagctctctctggttctctgatcagaaactgtctctaaacatttggcaagacattctgttgtgggattttgcctggtggtaggaaaagcttgggtattagcctcagaaagattctcagctctgccattaagagctgttgtccctagggcaagtctctgcctttctaagcctggttttcttctctggaaaatgaggctaatactttggcaaattgtcagaaaggttaaagaaagttgctgggcacagtggttcatgcctataatgccagcgctttgggattccaaggctggaggattgcttgaggataggagtttaagaccagcctggcaatacagtgagatcccatctctacaaaaaagaaaaaaggtagccaggcatggtggtgcactcctataaaaattgaagctgcagtgagctgagactgcaccactgcactccagcctgggtgactgaggaagaccttgtctccn

SEQ ID NO: 320366 - DNA, 1670 bp, Homo sapiens
gagtttgctgactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaaggtcagcacttaagcgatgcctttgcccaggtgaaccccctcaagaaggtgccagccttgaaggacggggacttcaccttgacggagagtgtggccatcctgctctacctgacgcgcaaatataaggtccctgactactggtaccctcaggacctgcaggcccgtgcccgtgtggatgagtacctggcatggcagcacacgactctgcggagaagctgcctccgggccttgtggcataaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcttaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctgcttctaactctaatgtgtgatttatttgactttcctctgtcccagacctggtcatggtctctatgcaaaagacaacccccttcccaggccgtgtgggtcagcttccccctgatgtttgccaagagtgaaattaataaatgtggctgaggccgcgtgcggtggctcacgcttgtaatcccagcatcttactgttaatcactagttttgcatttctcttgaggaactggtcaggaagagaaaacctagacagcagctctcctggtcaagacccagtcattcagaagcctaaatggcctgcctaggtgtttggctttaaactgttagcaggaatggagtactctgattgtgttttagaataatattccgggcctactacccctgcgcaccggtcctggcccagggctagctccttggtgagaaactcaaagaagtgggcactgtggctgcggttgtcctcggcggtgcccactacgccgatggaggagatggacagctgcgcgcagggctcggtggacccgctcagcgccctggccaggcccggccgtaccgtcacgttcacaagctgaggggaacatgaaaagttttacccgaagctggagccagtcgggctacgtctggggt

SEQ ID NO: 320367 - DNA, 997 bp, Homo sapiens
gagtttgctgactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaaggtcagcacttaagcgatgcctttgcccaggtgaaccccctcaagaaggtgccagccttgaaggacggggacttcaccttgacggagagtaccctcaggacctgcaggcccgtgcccgtgtggatgagtacctggcatggcagcacacgactctgcggagaagctgcctccgggccttgtggcataaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcttaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctg

SEQ ID NO: 320368 - DNA, 1007 bp, Homo sapiens
gagtttgctgactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaagacggagtctcgctctgtcgcccaggctggagtgcagtggcaggatcacagctcactgcaacctctgccgcccgaaaccttgtcctctgcctcttgttcctgctggggaggtcagcacttaagcgatgcctttgcccaggtgaaccccctcaagaaggtgccagccttgaaggacggggacttcaccttgacggagaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcttaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctg

SEQ ID NO: 320369 - DNA, 721 bp, Homo sapiens
gagtttgctgactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaaggtcagcacttaagcgatgcctttgcccaggtgaaccccctcaagaaggtgccagccttgaaggacggggacttcaccttgacggagagcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcttaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctg

SEQ ID NO: 320370 - DNA, 755 bp, Homo sapiens
gagtttgctgactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaaggtcagcacttaagcgatgcctttgcccaggtgaaccccctcaagaaggtgccagccttgaaggacggggacttcaccttgacggagagtgtggccatcctgctctacctgacgcgcaaatataaggtccctgactactggtaccctcaggacctgcaggcccgtgcccgtgtggatgagtacctggcatggcagcacacgactctgcggagaagctgcctccgggccttgtggcataaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatgtgagtgctgtgggcaggtgaacccactaggcagggggccctggctagttgctgaagtcctgcttatgctgccacaccgggctatggcactgtgcttaagtgtgtgtgcaaacacctcctggagatctgtggtccccaaatcagatgctgcccatccctgccctcacaaccatccatc

SEQ ID NO: 320371 - DNA, 1049 bp, Homo sapiens
gagtttgctgactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaaggtcagcacttaagcgatgcctttgcccaggtgaaccccctcaagaaggtgccagccttgaaggacggggacttcaccttgacggagagtgtggccatcctgctctacctgacgcgcaaatataaggtccctgactactggtaccctcaggacctgcaggcccgtgcccgtgtggatgagtacctggcatggcagcacacgactctgcggagaagctgcctccgggccttgtggcataaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcttaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctg

SEQ ID NO: 320372 - DNA, 898 bp, Homo sapiens
gagtttgctgactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaaggtcagcacttaagcgatgcctttgcccaggtgaaccccctcaagaaggtgccagccttgaaggacggggacttcaccttgacggagaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcttaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctg

SEQ ID NO: 320373 - DNA, 2048 bp, Homo sapiens
  misc_feature (2048)..(2048): n is a, c, g, or t
gagtttgctgactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaaggtcagcacttaagcgatgcctttgcccaggtgaaccccctcaagaaggtgccagccttgaaggacggggacttcaccttgacggagaggtaactgggaccctaggactgctgccaggcctgctggaaccatcctgttctaaccctctatttcatagacaaggaaactaaagtcttcagaggcagagagtctctgtgccccgcatcctgcagagagtcagtactggaccccaggcccttgccttcctgctattccagttcaccctgatgattagaaaagcaaatatctactttacttccacaccagtgctttggttgctggtgagtggtgagagtatccttgagacagggtaggccagaggacgatggcagctttgcccaccatggggcaggcctctggccaagcttgtgtggcgatggctcagtggcatctgggctgcccggtggctccatctctgggctgcagcttcccaggatgggtcttccccatggaagagccaccagatatggacgtcttacatcacagctggtcccaagaagttgaatcctcttcaggaaaagccaatctttccccagttctgccccttttgtcaccagagtcacccttcccctaacaagaacctggagtttgtgctttaaagctcatctctgaaatctcaggatggacgcacctccgatgaattcctctgacattctgccagggcccttcttcctccctggtgccccaggtgtcctgagtccttgtgtcactcagcgttgtgacccccaggtaccagccagagtcaatgtgcaatctctgcctctgtcactactctcaccttcaggtctgtggctcacagagacctgcagccctcctcagaggtggcttgaacaattggctgggagcaaaaggagctcctgggcaccctgcacagacaacggagtcgttaagctgggacacgtgtgtagccccagcttaaaagagaatataggcccgtggcagatacagaggttttctgcccttttggcctgcatgcccaacctttgggaaaccccaagttcctgaaagcttttctgtgtctccaaatggacacatcctgtgtccttccaggtccatgctcatctcatcaccatggcggccctcaaaacccagggaaggaggagagtgccagggggccttgtctgttctgttgttctaggatcctgcagctgcaggagtgcttcctgagtggtactttaggaagccaaactaccccagtcagcttagataggagctgattcttggcagaaagaatgacagaaagaacaaagggacacggaagcctttttgaacagtcaggccatcagaggctggtcggaatcccagcagatgagagtggataccgaatggaaagaactgagcttctttaaagctcagctttgatgccccgttctccctggaagctctctctggttctctgatcagaaactgtctctaaacatttggcaagacattctgttgtgggattttgcctggtggtaggaaaagcttgggtattagcctcagaaagattctcagctctgccattaagagctgttgtccctagggcaagtctctgcctttctaagcctggttttcttctctggaaaatgaggctaatactttggcaaattgtcagaaaggttaaagaaagttgctgggcacagtggttcatgcctataatgccagcgctttgggattccaaggctggaggattgcttgaggataggagtttaagaccagcctggcaatacagtgagatcccatctctacaaaaaagaaaaaaggtagccaggcatggtggtgcactcctataaaaattgaagctgcagtgagctgagactgcaccactgcactccagcctgggtgactgaggaagaccttgtctccn

SEQ ID NO: 320374 - DNA, 961 bp, Homo sapiens
gagtttgctgactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaagtgtggccatcctgctctacctgacgcgcaaatataaggtccctgactactggtaccctcaggacctgcaggcccgtgcccgtgtggatgagtacctggcatggcagcacacgactctgcggagaagctgcctccgggccttgtggcataaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcttaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctg

SEQ ID NO: 320375 - DNA, 827 bp, Homo sapiens
cttggacagcagtgtccagtgtacatgctccagtgcccatagtgggtgacctgacctgactgaccggaaaccagagggataccctcaggacctgcaggcccgtgcccgtgtggatgagtacctggcatggcagcacacgactctgcggagaagctgcctccgggccttgtggcataaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcttaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctg

SEQ ID NO: 320376 - DNA, 731 bp, Homo sapiens
ttcatagctgttctagcaggatcctttatagcttaggacacgactctgcgcgagaagctgcatccgggcttgttggcataaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcttaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctg

SEQ ID NO: 320377 - DNA, 609 bp, Homo sapiens
tatccaggaacaaagactttagaccatatgttctatgtcatgccagttgttcaggtatcctaacagttagaaccctttttcactcccagagtttctcagtttggctgataaattatgcgatcagacttcccattccagtcaagatggagcagcccaatttcctactagtctttcctcttacaacttaaaaaccctggacgtaatgcaacaaacataggaaaattgaaagatggaaagaaggagaggcttctagggacatcaggactcgaggaacaacacagaggtgagttccctgggttttcttttatcctctcatatatcccagattggacaatagagaagcctgcaacccggaactgccaataggtacaggtaaagaaacttgtccctataatcaaaggaccagaaaaagggcacaagaagaacctttttgataatgcttacctgcccaaaacaccaaaggaaaaactgtccatacccaccacctccaggtgtcagtggggctaagcagagagctgaatgtccacccacatgtggtggcaacaagctggggacgtaagtgggccttctgcttttgcaggaataatgtcagccaggcccatcagagaa

SEQ ID NO: 320378 - DNA, 345 bp, Homo sapiens
ccgcgggaatgtgaggctgcggcacgaccaggggccgccagggggcgcccgtcctccttcccgcctgtgcctcccctcatcctcgctctgcttggacagagggtggggaagactagaattcagctctcactccggcccgcctgcaaggtgatccaaaggaagtcgcttaccctcctggcatttccctttggaaaagacatacaaaaatagtccccacccacaagccccagaggggcgccccaagagcacaacgagctgtctcaggaatgctctggcaatagcagcctatttgcacgaattattattactaataatgtcttccttgttcaagtcaaacagacatct

SEQ ID NO: 320379 - DNA, 310 bp, Homo sapiens
gaggggctgaggagcggctcagtgtcacctcccacagccaccggccctgacccttaatccagacaccgatggaagtcgacttttcatatctttctcctgaaatgaactctgtttttaagccttttaccatttgaaatgcatgtgttgtgcgcgttggggatgggaggaggggctgaggagcggctcagtgtcacctcccacagccaccggccctgacccttaatccagacaccgatggaagtcgacttttcatatctttctcctgaaatgaactctgttttaaattggaataaattttgttcctaaatgc

SEQ ID NO: 320380 - DNA, 4089 bp, Homo sapiens
gccctcggccccgggccggcccgccccgcctcggccgccgcctggcgagccgccgggtccccgctcggccggtggccgaggccggagggccgcggcgggcggcggccgaggcggctccggccagggccgggccgggggccggggggcggcggcgggcaggcggccgcgtcggccggggccgggacgatgactctggagtccatgatggcgtgttgcctgagcgatgaggtgaaggagtccaagcggatcaacgccgagatcgagaagcagctgcggcgggacaagcgcgacgcccggcgcgagctcaagctgctgctgctcggcacgggcgagagcgggaagagcacgttcatcaagcagatgcgcatcatccacggcgccggctactcggaggaggacaagcgcggcttcaccaagctcgtctaccagaacatcttcaccgccatgcaggccatgatccgggccatggagacgctcaagatcctctacaagtacgagcagaacaaggccaatgcgctcctgatccgggaggtggacgtggagaaggtgaccaccttcgagcatcagtacgtcagtgccatcaagaccctgtgggaggacccgggcatccaggaatgctacgaccgcaggcgcgagtaccagctctccgactctgccaagtactacctgaccgacgttgaccgcatcgccaccttgggctacctgcccacccagcaggacgtgctgcgggtccgcgtgcccaccaccggcatcatcgagtaccctttcgacctggagaacatcatcttccggatggtggatgtggggggccagcggtcggagcggaggaagtggatccactgctttgagaacgtgacatccatcatgtttctcgtcgccctcagcgaatacgaccaagtcctggtggagtcggacaacgagaaccggatggaggagagcaaagccctgttccggactatcatcacctacccctggttccagaactcctccgtcatcctcttcctcaacaagaaggacctgctggaggacaagatcctgtactcgcacctggtggactacttccccgagttcgatggtccccagcgggacgcccaggcggcgcgggagttcatcctgaagatgttcgtggacctgaaccccgacagcgacaagatcatctactcacacttcacgtgtgccaccgacacggagaacatccgcttcgtgttcgcggccgtgaaggacaccatcctgcagctcaacctcaaggagtacaacctggtctgagcgcccaggcccagggagacgggatggagacacggggcaggaccttccttccacggagcctgcggctgccgggcgggtggcgctgccgagtccgggccggggcctctgcccgcgggaggagatttttttttttcatatttttaacaaatggtttttatttcacagttatcaggggatgtacatctctccctccgtacacttcgcgcaccttctcaccttttgtcaacggcaaaggcagcctttttctggccttgacttatggctcgcttttttctaaaaaaaaaaaaaaaaagaaagaaagaaaaaaagcaacgaaacataaaacacacaagcgccccgtgcccccagtgactctgggcctcacagagcccccgccagccagcatggggccccgccctgcagccagtcacgcgcccccacaccgcagccccccgtggctgtccttccaaccccacgtgctttttctttctcctgcccgcttcttttcttcatcacaaaaggcgtggagactcggagacggacgtttttccccttttttaagttattgacgcccagcgcgcctcgcctcttcacccatcaacgctgtgctttgcccactggactcctgaagagggggtggggggctccctcggtcgcccaccctgggaagtgcctaaccttttattttattttatttttttgaggaaaaagaacgcctgactcacaggttgaagaaacaccctgggccctctctcatggccgggttccccgtccctctgcagaggctgggaagggtccccgggctggagccacgggggcttctctgggctgtgcctccggggccaacactggctgcttggggctgcccggggactccagagggctgcacggccaccctgccctggctagagcgcaccccaccggagcccacgtgggctgggcggctggagggatggtcccccggtgacactgggagaaaggccacttggatgggggcgtttctgttttgttccgctttgtgatgtcaccaatttggaaacagcgagggtgggtggggacttttacagaatattctcaggtgtgtacccgagaggcagagagagggacgtggccggcagctctgtgcgtggccttgtcccaagcacttgcgcccgcccccgagcgccgcccccggggagcgggaagccagcactcgcactttggccaggggcgcgtggaaggtggtggcaggcaccggcctgggcagcttccaggcctggctggccacgaccacggcccgagggggagcccgccaggccacgccgcactgagccacagccccgggggccgcctcccggggccccttgaggcactgaggcaccgagactggttctccccgagagactcggaaggtggggaacgaggggactgtgtttggggaggtggctttttcgtctgctgttgactgaacactacagcgccctgtggttccgggcttcgcacagctgtcccagggatggatcgcctgtgctgccttcgcccgccgccacaccgggaccctgcacggctgcttctggcctcgacagatgacaaaagaaacagccccaaaatacgaccactccaaccagcagttcccgcctgcctgcccgccactgtcaggcctgccctggcctcctcgtccgcagggctgtctgctggcttctgggggcagaagagcggggagccccgtggaagggtcaggggagaccaggtcagggcagctacatttctggtgatcagccccatggggagacggggctggcgggatacccccccccggcttccccacaccacttctgtctcacccggaagcgtcctttttttgtgccaggtgtctacctaagagggttggtgccagaagccccccatggcgagtgctggggcccggcggtgccctgggggagcagatggggccacccctggcagggccgctacaaccttttccagcagcggagccctctggggggcctgtgcttgtggcatctctgagggcccagattgcacaaggtgacctggccgtggcctgagggtggagtcgcccagcacgcaggccggggcgctgcggggctaagtattaggccttcccagggagggggcgtgccaagcatcccagagccgggctgggaccgccaaaacgtcgtggcctggatcctctgggtctgagtgcctgatcccctgccccccaaaaaagcagaggtaggtgttgcaggcccagggcaggggtgcctgccccaggagagtcccaggcagtggttctcgtgccagtggcacccaggggcaaggacagccaacccccacccttgccacgtgtggggccacgtgggcatgtggggtgtgtgtttttaccttggtgaatctcacctgccaacgatttctcgtgagtgccgaccaccttctccgaccatgttacgcccgggcggcagcagcccccggccactgcaaacccatgccctgggtcccccggctcccccagggaggcatccccgtgccaatgtcccccagtggtggcagcagatcctgtggccggcctggcggacgggacccagtgatacttgtatattacacagtcctgatttcagacaatttcaaccttaatctatttaaaaaagaatattctatacaagctgtttttaagccttttaccatttgaaatgcatgtgttgtgcgcgttggggatgggaggaggggctgaggagcggctcagtgtcacctcccacagccaccggccctgacccttaatccagacaccgatggaagtcgacttttcatatctttctcctgaaatgaactctgttttaaattggaataaattttgttcctaaatgc

SEQ ID NO: 320381 - DNA, 3904 bp, Homo sapiens
gccctcggccccgggccggcccgccccgcctcggccgccgcctggcgagccgccgggtccccgctcggccggtggccgaggccggagggccgcggcgggcggcggccgaggcggctccggccagggccgggccgggggccggggggcggcggcgggcaggcggccgcgtcggccggggccgggacgatgactctggagtccatgatggcgtgttgcctgagcgatgaggtgaaggagtccaagcggatcaacgccgagatcgagaagcagctgcggcgggacaagcgcgacgcccggcgcgagctcaagctgctgctgctcggccaatgcgctcctgatccgggaggtggacgtggagaaggtgaccaccttcgagcatcagtacgtcagtgccatcaagaccctgtgggaggacccgggcatccaggaatgctacgaccgcaggcgcgagtaccagctctccgactctgccaagtactacctgaccgacgttgaccgcatcgccaccttgggctacctgcccacccagcaggacgtgctgcgggtccgcgtgcccaccaccggcatcatcgagtaccctttcgacctggagaacatcatcttccggatggtggatgtggggggccagcggtcggagcggaggaagtggatccactgctttgagaacgtgacatccatcatgtttctcgtcgccctcagcgaatacgaccaagtcctggtggagtcggacaacgagaaccggatggaggagagcaaagccctgttccggactatcatcacctacccctggttccagaactcctccgtcatcctcttcctcaacaagaaggacctgctggaggacaagatcctgtactcgcacctggtggactacttccccgagttcgatggtccccagcgggacgcccaggcggcgcgggagttcatcctgaagatgttcgtggacctgaaccccgacagcgacaagatcatctactcacacttcacgtgtgccaccgacacggagaacatccgcttcgtgttcgcggccgtgaaggacaccatcctgcagctcaacctcaaggagtacaacctggtctgagcgcccaggcccagggagacgggatggagacacggggcaggaccttccttccacggagcctgcggctgccgggcgggtggcgctgccgagtccgggccggggcctctgcccgcgggaggagatttttttttttcatatttttaacaaatggtttttatttcacagttatcaggggatgtacatctctccctccgtacacttcgcgcaccttctcaccttttgtcaacggcaaaggcagcctttttctggccttgacttatggctcgcttttttctaaaaaaaaaaaaaaaaagaaagaaagaaaaaaagcaacgaaacataaaacacacaagcgccccgtgcccccagtgactctgggcctcacagagcccccgccagccagcatggggccccgccctgcagccagtcacgcgcccccacaccgcagccccccgtggctgtccttccaaccccacgtgctttttctttctcctgcccgcttcttttcttcatcacaaaaggcgtggagactcggagacggacgtttttccccttttttaagttattgacgcccagcgcgcctcgcctcttcacccatcaacgctgtgctttgcccactggactcctgaagagggggtggggggctccctcggtcgcccaccctgggaagtgcctaaccttttattttattttatttttttgaggaaaaagaacgcctgactcacaggttgaagaaacaccctgggccctctctcatggccgggttccccgtccctctgcagaggctgggaagggtccccgggctggagccacgggggcttctctgggctgtgcctccggggccaacactggctgcttggggctgcccggggactccagagggctgcacggccaccctgccctggctagagcgcaccccaccggagcccacgtgggctgggcggctggagggatggtcccccggtgacactgggagaaaggccacttggatgggggcgtttctgttttgttccgctttgtgatgtcaccaatttggaaacagcgagggtgggtggggacttttacagaatattctcaggtgtgtacccgagaggcagagagagggacgtggccggcagctctgtgcgtggccttgtcccaagcacttgcgcccgcccccgagcgccgcccccggggagcgggaagccagcactcgcactttggccaggggcgcgtggaaggtggtggcaggcaccggcctgggcagcttccaggcctggctggccacgaccacggcccgagggggagcccgccaggccacgccgcactgagccacagccccgggggccgcctcccggggccccttgaggcactgaggcaccgagactggttctccccgagagactcggaaggtggggaacgaggggactgtgtttggggaggtggctttttcgtctgctgttgactgaacactacagcgccctgtggttccgggcttcgcacagctgtcccagggatggatcgcctgtgctgccttcgcccgccgccacaccgggaccctgcacggctgcttctggcctcgacagatgacaaaagaaacagccccaaaatacgaccactccaaccagcagttcccgcctgcctgcccgccactgtcaggcctgccctggcctcctcgtccgcagggctgtctgctggcttctgggggcagaagagcggggagccccgtggaagggtcaggggagaccaggtcagggcagctacatttctggtgatcagccccatggggagacggggctggcgggatacccccccccggcttccccacaccacttctgtctcacccggaagcgtcctttttttgtgccaggtgtctacctaagagggttggtgccagaagccccccatggcgagtgctggggcccggcggtgccctgggggagcagatggggccacccctggcagggccgctacaaccttttccagcagcggagccctctggggggcctgtgcttgtggcatctctgagggcccagattgcacaaggtgacctggccgtggcctgagggtggagtcgcccagcacgcaggccggggcgctgcggggctaagtattaggccttcccagggagggggcgtgccaagcatcccagagccgggctgggaccgccaaaacgtcgtggcctggatcctctgggtctgagtgcctgatcccctgccccccaaaaaagcagaggtaggtgttgcaggcccagggcaggggtgcctgccccaggagagtcccaggcagtggttctcgtgccagtggcacccaggggcaaggacagccaacccccacccttgccacgtgtggggccacgtgggcatgtggggtgtgtgtttttaccttggtgaatctcacctgccaacgatttctcgtgagtgccgaccaccttctccgaccatgttacgcccgggcggcagcagcccccggccactgcaaacccatgccctgggtcccccggctcccccagggaggcatccccgtgccaatgtcccccagtggtggcagcagatcctgtggccggcctggcggacgggacccagtgatacttgtatattacacagtcctgatttcagacaatttcaaccttaatctatttaaaaaagaatattctatacaagctgtttttaagccttttaccatttgaaatgcatgtgttgtgcgcgttggggatgggaggaggggctgaggagcggctcagtgtcacctcccacagccaccggccctgacccttaatccagacaccgatggaagtcgacttttcatatctttctcctgaaatgaactctgttttaaattggaataaattttgttcctaaatgc

SEQ ID NO: 320382 - DNA, 4483 bp, Homo sapiens
cattgtttctctgccagccgcctctgtccaccacacgctggcagagggccggccaggtgctgtgggatgcagctggaggccttgaaggccggtgggatcgtcccagtgcgtgaggagaggctcctgctccctcaggtggggacaagacacggggggacccggatcccagccctgccggccgccgcaggcgtgcaggagaggcctcgcgctccagacgggctgtggcctggtgtcggcacacccactgtcctcccgcctggccacagctgctggtgcgggccctcttgtcccttagagtcacctggcacatctgtcatccaccggtgcctgctggactcccccgcagaccagaccaggtggatttcaccactcacatgcccaaagcagccccgctctcctcggcagagttgcagggaccccggccttccctggggcctggggccagggcctgaggggcactctccgcttctgcctttgtattctttcaaggagaccaaagtgccttttctcgttatagaaaacttagaaaagtcacaagtagaaagaggcaaacgtcccgtaaggaacgcacgcccgcagacatcgtctgagctgattttctttctcccgcctgtgcgtggcctgagagtgtgaggttgagctgctcaccacgcggggcagggcgctgcgcctgctcttctgccccaggaggataccggcaactctgccctctgcagccgtcactggagggtccctgcagggagcaactgtggcatcagtgtttactcctgcgagtgacgcttggtgaacatctgtgtccctggcccagtgaggggaaaggcttctgtgctcagggtgacatccagatgccagatgtagggtccctgggcacccatcgcaggttcccgcagcagctggcgcccagaatcctctgggttctcacacccccacactagcgcccgcttccctgggcccagtggtctcaggcccctttgccagtgagggaagggtctgcggtggtcacccctggaggcggtgcggccgctctctgagagcgtccttgcccgttctaagagtgggggctcttcctgctccagccgatgtcagtctggtgtggcaggaggggcttgggtgggagccgtcctgggattgcagattgggccttggggcgccaggtggctgagtcctggcgctgtgtcctttcaggatggtggatgtggggggccagcggtcggagcggaggaagtggatccactgctttgagaacgtgacatccatcatgtttctcgtcgccctcagcgaatacgaccaagtcctggtggagtcggacaacgagaaccggatggaggagagcaaagccctgttccggactatcatcacctacccctggttccagaactcctccgtcatcctcttcctcaacaagaaggacctgctggaggacaagatcctgtactcgcacctggtggactacttccccgagttcgatggtccccagcgggacgcccaggcggcgcgggagttcatcctgaagatgttcgtggacctgaaccccgacagcgacaagatcatctactcacacttcacgtgtgccaccgacacggagaacatccgcttcgtgttcgcggccgtgaaggacaccatcctgcagctcaacctcaaggagtacaacctggtctgagcgcccaggcccagggagacgggatggagacacggggcaggaccttccttccacggagcctgcggctgccgggcgggtggcgctgccgagtccgggccggggcctctgcccgcgggaggagatttttttttttcatatttttaacaaatggtttttatttcacagttatcaggggatgtacatctctccctccgtacacttcgcgcaccttctcaccttttgtcaacggcaaaggcagcctttttctggccttgacttatggctcgcttttttctaaaaaaaaaaaaaaaaagaaagaaagaaaaaaagcaacgaaacataaaacacacaagcgccccgtgcccccagtgactctgggcctcacagagcccccgccagccagcatggggccccgccctgcagccagtcacgcgcccccacaccgcagccccccgtggctgtccttccaaccccacgtgctttttctttctcctgcccgcttcttttcttcatcacaaaaggcgtggagactcggagacggacgtttttccccttttttaagttattgacgcccagcgcgcctcgcctcttcacccatcaacgctgtgctttgcccactggactcctgaagagggggtggggggctccctcggtcgcccaccctgggaagtgcctaaccttttattttattttatttttttgaggaaaaagaacgcctgactcacaggttgaagaaacaccctgggccctctctcatggccgggttccccgtccctctgcagaggctgggaagggtccccgggctggagccacgggggcttctctgggctgtgcctccggggccaacactggctgcttggggctgcccggggactccagagggctgcacggccaccctgccctggctagagcgcaccccaccggagcccacgtgggctgggcggctggagggatggtcccccggtgacactgggagaaaggccacttggatgggggcgtttctgttttgttccgctttgtgatgtcaccaatttggaaacagcgagggtgggtggggacttttacagaatattctcaggtgtgtacccgagaggcagagagagggacgtggccggcagctctgtgcgtggccttgtcccaagcacttgcgcccgcccccgagcgccgcccccggggagcgggaagccagcactcgcactttggccaggggcgcgtggaaggtggtggcaggcaccggcctgggcagcttccaggcctggctggccacgaccacggcccgagggggagcccgccaggccacgccgcactgagccacagccccgggggccgcctcccggggccccttgaggcactgaggcaccgagactggttctccccgagagactcggaaggtggggaacgaggggactgtgtttggggaggtggctttttcgtctgctgttgactgaacactacagcgccctgtggttccgggcttcgcacagctgtcccagggatggatcgcctgtgctgccttcgcccgccgccacaccgggaccctgcacggctgcttctggcctcgacagatgacaaaagaaacagccccaaaatacgaccactccaaccagcagttcccgcctgcctgcccgccactgtcaggcctgccctggcctcctcgtccgcagggctgtctgctggcttctgggggcagaagagcggggagccccgtggaagggtcaggggagaccaggtcagggcagctacatttctggtgatcagccccatggggagacggggctggcgggatacccccccccggcttccccacaccacttctgtctcacccggaagcgtcctttttttgtgccaggtgtctacctaagagggttggtgccagaagccccccatggcgagtgctggggcccggcggtgccctgggggagcagatggggccacccctggcagggccgctacaaccttttccagcagcggagccctctggggggcctgtgcttgtggcatctctgagggcccagattgcacaaggtgacctggccgtggcctgagggtggagtcgcccagcacgcaggccggggcgctgcggggctaagtattaggccttcccagggagggggcgtgccaagcatcccagagccgggctgggaccgccaaaacgtcgtggcctggatcctctgggtctgagtgcctgatcccctgccccccaaaaaagcagaggtaggtgttgcaggcccagggcaggggtgcctgccccaggagagtcccaggcagtggttctcgtgccagtggcacccaggggcaaggacagccaacccccacccttgccacgtgtggggccacgtgggcatgtggggtgtgtgtttttaccttggtgaatctcacctgccaacgatttctcgtgagtgccgaccaccttctccgaccatgttacgcccgggcggcagcagcccccggccactgcaaacccatgccctgggtcccccggctcccccagggaggcatccccgtgccaatgtcccccagtggtggcagcagatcctgtggccggcctggcggacgggacccagtgatacttgtatattacacagtcctgatttcagacaatttcaaccttaatctatttaaaaaagaatattctatacaagctgtttttaagccttttaccatttgaaatgcatgtgttgtgcgcgttggggatgggaggaggggctgaggagcggctcagtgtcacctcccacagccaccggccctgacccttaatccagacaccgatggaagtcgacttttcatatctttctcctgaaatgaactctgttttaaattggaataaattttgttcctaaatgc

SEQ ID NO: 320383 - DNA, 3204 bp, Homo sapiens
gccctcggccccgggccggcccgccccgcctcggccgccgcctggcgagccgccgggtccccgctcggccggtggccgaggccggagggccgcggcgggcggcggccgaggcggctccggccagggccgggccgggggccggggggcggcggcgggcaggcggccgcgtcggccggggccgggacgatgactctggagtccatgatggcgtgttgcctgagcgatgaggtgaagatgttcgtggacctgaaccccgacagcgacaagatcatctactcacacttcacgtgtgccaccgacacggagaacatccgcttcgtgttcgcggccgtgaaggacaccatcctgcagctcaacctcaaggagtacaacctggtctgagcgcccaggcccagggagacgggatggagacacggggcaggaccttccttccacggagcctgcggctgccgggcgggtggcgctgccgagtccgggccggggcctctgcccgcgggaggagatttttttttttcatatttttaacaaatggtttttatttcacagttatcaggggatgtacatctctccctccgtacacttcgcgcaccttctcaccttttgtcaacggcaaaggcagcctttttctggccttgacttatggctcgcttttttctaaaaaaaaaaaaaaaaagaaagaaagaaaaaaagcaacgaaacataaaacacacaagcgccccgtgcccccagtgactctgggcctcacagagcccccgccagccagcatggggccccgccctgcagccagtcacgcgcccccacaccgcagccccccgtggctgtccttccaaccccacgtgctttttctttctcctgcccgcttcttttcttcatcacaaaaggcgtggagactcggagacggacgtttttccccttttttaagttattgacgcccagcgcgcctcgcctcttcacccatcaacgctgtgctttgcccactggactcctgaagagggggtggggggctccctcggtcgcccaccctgggaagtgcctaaccttttattttattttatttttttgaggaaaaagaacgcctgactcacaggttgaagaaacaccctgggccctctctcatggccgggttccccgtccctctgcagaggctgggaagggtccccgggctggagccacgggggcttctctgggctgtgcctccggggccaacactggctgcttggggctgcccggggactccagagggctgcacggccaccctgccctggctagagcgcaccccaccggagcccacgtgggctgggcggctggagggatggtcccccggtgacactgggagaaaggccacttggatgggggcgtttctgttttgttccgctttgtgatgtcaccaatttggaaacagcgagggtgggtggggacttttacagaatattctcaggtgtgtacccgagaggcagagagagggacgtggccggcagctctgtgcgtggccttgtcccaagcacttgcgcccgcccccgagcgccgcccccggggagcgggaagccagcactcgcactttggccaggggcgcgtggaaggtggtggcaggcaccggcctgggcagcttccaggcctggctggccacgaccacggcccgagggggagcccgccaggccacgccgcactgagccacagccccgggggccgcctcccggggccccttgaggcactgaggcaccgagactggttctccccgagagactcggaaggtggggaacgaggggactgtgtttggggaggtggctttttcgtctgctgttgactgaacactacagcgccctgtggttccgggcttcgcacagctgtcccagggatggatcgcctgtgctgccttcgcccgccgccacaccgggaccctgcacggctgcttctggcctcgacagatgacaaaagaaacagccccaaaatacgaccactccaaccagcagttcccgcctgcctgcccgccactgtcaggcctgccctggcctcctcgtccgcagggctgtctgctggcttctgggggcagaagagcggggagccccgtggaagggtcaggggagaccaggtcagggcagctacatttctggtgatcagccccatggggagacggggctggcgggatacccccccccggcttccccacaccacttctgtctcacccggaagcgtcctttttttgtgccaggtgtctacctaagagggttggtgccagaagccccccatggcgagtgctggggcccggcggtgccctgggggagcagatggggccacccctggcagggccgctacaaccttttccagcagcggagccctctggggggcctgtgcttgtggcatctctgagggcccagattgcacaaggtgacctggccgtggcctgagggtggagtcgcccagcacgcaggccggggcgctgcggggctaagtattaggccttcccagggagggggcgtgccaagcatcccagagccgggctgggaccgccaaaacgtcgtggcctggatcctctgggtctgagtgcctgatcccctgccccccaaaaaagcagaggtaggtgttgcaggcccagggcaggggtgcctgccccaggagagtcccaggcagtggttctcgtgccagtggcacccaggggcaaggacagccaacccccacccttgccacgtgtggggccacgtgggcatgtggggtgtgtgtttttaccttggtgaatctcacctgccaacgatttctcgtgagtgccgaccaccttctccgaccatgttacgcccgggcggcagcagcccccggccactgcaaacccatgccctgggtcccccggctcccccagggaggcatccccgtgccaatgtcccccagtggtggcagcagatcctgtggccggcctggcggacgggacccagtgatacttgtatattacacagtcctgatttcagacaatttcaaccttaatctatttaaaaaagaatattctatacaagctgtttttaagccttttaccatttgaaatgcatgtgttgtgcgcgttggggatgggaggaggggctgaggagcggctcagtgtcacctcccacagccaccggccctgacccttaatccagacaccgatggaagtcgacttttcatatctttctcctgaaatgaactctgttttaaattggaataaattttgttcctaaatgc

SEQ ID NO: 320384 - DNA, 960 bp, Homo sapiens
gccctcggccccgggccggcccgccccgcctcggccgccgcctggcgagccgccgggtccccgctcggccggtggccgaggccggagggccgcggcgggcggcggccgaggcggctccggccagggccgggccgggggccggggggcggcggcgggcaggcggccgcgtcggccggggccgggacgatgactctggagtccatgatggcgtgttgcctgagcgatgaggtgaaggagtccaagcggatcaacgccgagatcgagaagcagctgcggcgggacaagcgcgacgcccggcgcgagctcaagctgctgctgctcggcacgggcgagagcgggaagagcacgttcatcaagcagatgcgcatcatccacggcgccggctactcggaggaggacaagcgcggcttcaccaagctcgtctaccagaacatcttcaccgccatgcaggccatgatccgggccatggagacgctcaagatcctctacaagtacgagcagaacaaggccaatgcgctcctgatccgggaggtggacgtggagaaggtgaccaccttcgagcatcagtacgtcagtgccatcaagaccctgtgggaggacccgggcatccaggaatgctacgaccgcaggcgcgagtaccagctctccgactctgccaagtactacctgaccgacgttgaccgcatcgccaccttgggctacctgcccacccagcaggacgtgctgcgggtccgcgtgcccaccaccggcatcatcgagtaccctttcgacctggagaacatcatcttccgctgggcgtggttgtgtgcacctgtggtcccagctactcaggaggctgaggcaggaggatcgctcaagcccaggaggttgaggctgaagtgagccatgatggcaccactggactccagcctgggcgacagagggagaccctgtttcgtcttattaaacaaaagaaagccc

SEQ ID NO: 320385 - DNA, 405 bp, Homo sapiens
gaggcctgggccgtgacagtagtgccctggggctacagtgggattggcaccgcagctcacctggggagggaggggagctgcggcccgtcaggcatgcagtgggctgggggtcgagctgggtgggccgtgggccttactcgctcatcccctgggagtgacaaaggggcccacgagtcccttgccctgggccgggctggggcacagcctcaccctctgccctcccccaggtccccagcgggacgcccaggcggcgcgggagttcatcctgaagatgttcgtggacctgaaccccgacagcgacaagatcatctactcacacttcacgtgtgccaccgacacggagaacatccgcttcgtgttcgcggccgtgaaggacaccatcctgcagctcaacctcaaggagta

SEQ ID NO: 320386 - DNA, 3918 bp, Homo sapiens
gccctcggccccgggccggcccgccccgcctcggccgccgcctggcgagccgccgggtccccgctcggccggtggccgaggccggagggccgcggcgggcggcggccgaggcggctccggccagggccgggccgggggccggggggcggcggcgggcaggcggccgcgtcggccggggccgggacgatgactctggagtccatgatggcgtgttgcctgagcgatgaggtgaaggagtccaagcggatcaacgccgagatcgagaagcagctgcggcgggacaagcgcgacgcccggcgcgagctcaagctgctgctgctcggcacgggcgagagcgggaagagcacgttcatcaagcagatgcgcatcatccacggcgccggctactcggaggaggacaagcgcggcttcaccaagctcgtctaccagaacatcttcaccgccatgcaggccatgatccgggccatggagacgctcaagatcctctacaagtacgagcagaacaaggccaatgcgctcctgatccgggaggtggacgtggagaaggtgaccaccttcgagcatcagtacgtcagtgccatcaagaccctgtgggaggacccgggcatccaggaatgctacgaccgcaggcgcgagtaccagctctccgactctgccaagtactacctgaccgacgttgaccgcatcgccaccttgggctacctgcccacccagcaggacgtgctgcgggtccgcgtgcccaccaccggcatcatcgagtaccctttcgacctggagaacatcatcttccggatggtggatgtggggggccagcggtcggagcggaggaagtggatccactgctttgagaacgtgacatccatcatgtttctcgtcgccctcagcgaatacgaccaagtcctggtggagtcggacaacgagaaccggatggaggagagcaaagccctgttccggactatcatcacctacccctggttccagaactcctccgtcatcctcttcctcaacaagaaggacctgctggaggacaagatcctgtactcgcacctggtggactacttccccgagttcgatggtccccagcgggacgcccaggcggcgcgggagttcatcctgaagatgttcgtggacctgaaccccgacagcgacaagatcatctactcacacttcacgtgtgccaccgacacggagaacatccgcttcgtgttcgcggccgtgaaggacaccatcctgcagctcaacctcaaggagtacaacctgttatcaggggatgtacatctctccctccgtacacttcgcgcaccttctcaccttttgtcaacggcaaaggcagcctttttctggccttgacttatggctcgcttttttctaaaaaaaaaaaaaaaaagaaagaaagaaaaaaagcaacgaaacataaaacacacaagcgccccgtgcccccagtgactctgggcctcacagagcccccgccagccagcatggggccccgccctgcagccagtcacgcgcccccacaccgcagccccccgtggctgtccttccaaccccacgtgctttttctttctcctgcccgcttcttttcttcatcacaaaaggcgtggagactcggagacggacgtttttccccttttttaagttattgacgcccagcgcgcctcgcctcttcacccatcaacgctgtgctttgcccactggactcctgaagagggggtggggggctccctcggtcgcccaccctgggaagtgcctaaccttttattttattttatttttttgaggaaaaagaacgcctgactcacaggttgaagaaacaccctgggccctctctcatggccgggttccccgtccctctgcagaggctgggaagggtccccgggctggagccacgggggcttctctgggctgtgcctccggggccaacactggctgcttggggctgcccggggactccagagggctgcacggccaccctgccctggctagagcgcaccccaccggagcccacgtgggctgggcggctggagggatggtcccccggtgacactgggagaaaggccacttggatgggggcgtttctgttttgttccgctttgtgatgtcaccaatttggaaacagcgagggtgggtggggacttttacagaatattctcaggtgtgtacccgagaggcagagagagggacgtggccggcagctctgtgcgtggccttgtcccaagcacttgcgcccgcccccgagcgccgcccccggggagcgggaagccagcactcgcactttggccaggggcgcgtggaaggtggtggcaggcaccggcctgggcagcttccaggcctggctggccacgaccacggcccgagggggagcccgccaggccacgccgcactgagccacagccccgggggccgcctcccggggccccttgaggcactgaggcaccgagactggttctccccgagagactcggaaggtggggaacgaggggactgtgtttggggaggtggctttttcgtctgctgttgactgaacactacagcgccctgtggttccgggcttcgcacagctgtcccagggatggatcgcctgtgctgccttcgcccgccgccacaccgggaccctgcacggctgcttctggcctcgacagatgacaaaagaaacagccccaaaatacgaccactccaaccagcagttcccgcctgcctgcccgccactgtcaggcctgccctggcctcctcgtccgcagggctgtctgctggcttctgggggcagaagagcggggagccccgtggaagggtcaggggagaccaggtcagggcagctacatttctggtgatcagccccatggggagacggggctggcgggatacccccccccggcttccccacaccacttctgtctcacccggaagcgtcctttttttgtgccaggtgtctacctaagagggttggtgccagaagccccccatggcgagtgctggggcccggcggtgccctgggggagcagatggggccacccctggcagggccgctacaaccttttccagcagcggagccctctggggggcctgtgcttgtggcatctctgagggcccagattgcacaaggtgacctggccgtggcctgagggtggagtcgcccagcacgcaggccggggcgctgcggggctaagtattaggccttcccagggagggggcgtgccaagcatcccagagccgggctgggaccgccaaaacgtcgtggcctggatcctctgggtctgagtgcctgatcccctgccccccaaaaaagcagaggtaggtgttgcaggcccagggcaggggtgcctgccccaggagagtcccaggcagtggttctcgtgccagtggcacccaggggcaaggacagccaacccccacccttgccacgtgtggggccacgtgggcatgtggggtgtgtgtttttaccttggtgaatctcacctgccaacgatttctcgtgagtgccgaccaccttctccgaccatgttacgcccgggcggcagcagcccccggccactgcaaacccatgccctgggtcccccggctcccccagggaggcatccccgtgccaatgtcccccagtggtggcagcagatcctgtggccggcctggcggacgggacccagtgatacttgtatattacacagtcctgatttcagacaatttcaaccttaatctatttaaaaaagaatattctatacaagctgtttttaagccttttaccatttgaaatgcatgtgttgtgcgcgttggggatgggaggaggggctgaggagcggctcagtgtcacctcccacagccaccggccctgacccttaatccagacaccgatggaagtcgacttttcatatctttctcctgaaatgaactctgttttaaattggaataaattttgttcctaaatgc

SEQ ID NO: 320387 - DNA, 4435 bp, Homo sapiens
cattgtttctctgccagccgcctctgtccaccacacgctggcagagggccggccaggtgctgtgggatgcagctggaggccttgaaggccggtgggatcgtcccagtgcgtgaggagaggctcctgctccctcaggtggggacaagacacggggggacccggatcccagccctgccggccgccgcaggcgtgcaggagaggcctcgcgctccagacgggctgtggcctggtgtcggcacacccactgtcctcccgcctggccacagctgctggtgcgggccctcttgtcccttagagtcacctggcacatctgtcatccaccggtgcctgctggactcccccgcagaccagaccaggtggatttcaccactcacatgcccaaagcagccccgctctcctcggcagagttgcagggaccccggccttccctggggcctggggccagggcctgaggggcactctccgcttctgcctttgtattctttcaaggagaccaaagtgccttttctcgttatagaaaacttagaaaagtcacaagtagaaagaggcaaacgtcccgtaaggaacgcacgcccgcagacatcgtctgagctgattttctttctcccgcctgtgcgtggcctgagagtgtgaggttgagctgctcaccacgcggggcagggcgctgcgcctgctcttctgccccaggaggataccggcaactctgccctctgcagccgtcactggagggtccctgcagggagcaactgtggcatcagtgtttactcctgcgagtgacgcttggtgaacatctgtgtccctggcccagtgaggggaaaggcttctgtgctcagggtgacatccagatgccagatgtagggtccctgggcacccatcgcaggttcccgcagcagctggcgcccagaatcctctgggttctcacacccccacactagcgcccgcttccctgggcccagtggtctcaggcccctttgccagtgagggaagggtctgcggtggtcacccctggaggcggtgcggccgctctctgagagcgtccttgcccgttctaagagtgggggctcttcctgctccagccgatgtcagtctggtgtggcaggaggggcttgggtgggagccgtcctgggattgcagattgggccttggggcgccaggtggctgagtcctggcgctgtgtcctttcaggatggtggatgtggggggccagcggtcggagcggaggaagtggatccactgctttgagaacgtgacatccatcatgtttctcgtcgccctcagcgaatacgaccaagtcctggtggagtcggacaacgagccctggttccagaactcctccgtcatcctcttcctcaacaagaaggacctgctggaggacaagatcctgtactcgcacctggtggactacttccccgagttcgatggtccccagcgggacgcccaggcggcgcgggagttcatcctgaagatgttcgtggacctgaaccccgacagcgacaagatcatctactcacacttcacgtgtgccaccgacacggagaacatccgcttcgtgttcgcggccgtgaaggacaccatcctgcagctcaacctcaaggagtacaacctggtctgagcgcccaggcccagggagacgggatggagacacggggcaggaccttccttccacggagcctgcggctgccgggcgggtggcgctgccgagtccgggccggggcctctgcccgcgggaggagatttttttttttcatatttttaacaaatggtttttatttcacagttatcaggggatgtacatctctccctccgtacacttcgcgcaccttctcaccttttgtcaacggcaaaggcagcctttttctggccttgacttatggctcgcttttttctaaaaaaaaaaaaaaaaagaaagaaagaaaaaaagcaacgaaacataaaacacacaagcgccccgtgcccccagtgactctgggcctcacagagcccccgccagccagcatggggccccgccctgcagccagtcacgcgcccccacaccgcagccccccgtggctgtccttccaaccccacgtgctttttctttctcctgcccgcttcttttcttcatcacaaaaggcgtggagactcggagacggacgtttttccccttttttaagttattgacgcccagcgcgcctcgcctcttcacccatcaacgctgtgctttgcccactggactcctgaagagggggtggggggctccctcggtcgcccaccctgggaagtgcctaaccttttattttattttatttttttgaggaaaaagaacgcctgactcacaggttgaagaaacaccctgggccctctctcatggccgggttccccgtccctctgcagaggctgggaagggtccccgggctggagccacgggggcttctctgggctgtgcctccggggccaacactggctgcttggggctgcccggggactccagagggctgcacggccaccctgccctggctagagcgcaccccaccggagcccacgtgggctgggcggctggagggatggtcccccggtgacactgggagaaaggccacttggatgggggcgtttctgttttgttccgctttgtgatgtcaccaatttggaaacagcgagggtgggtggggacttttacagaatattctcaggtgtgtacccgagaggcagagagagggacgtggccggcagctctgtgcgtggccttgtcccaagcacttgcgcccgcccccgagcgccgcccccggggagcgggaagccagcactcgcactttggccaggggcgcgtggaaggtggtggcaggcaccggcctgggcagcttccaggcctggctggccacgaccacggcccgagggggagcccgccaggccacgccgcactgagccacagccccgggggccgcctcccggggccccttgaggcactgaggcaccgagactggttctccccgagagactcggaaggtggggaacgaggggactgtgtttggggaggtggctttttcgtctgctgttgactgaacactacagcgccctgtggttccgggcttcgcacagctgtcccagggatggatcgcctgtgctgccttcgcccgccgccacaccgggaccctgcacggctgcttctggcctcgacagatgacaaaagaaacagccccaaaatacgaccactccaaccagcagttcccgcctgcctgcccgccactgtcaggcctgccctggcctcctcgtccgcagggctgtctgctggcttctgggggcagaagagcggggagccccgtggaagggtcaggggagaccaggtcagggcagctacatttctggtgatcagccccatggggagacggggctggcgggatacccccccccggcttccccacaccacttctgtctcacccggaagcgtcctttttttgtgccaggtgtctacctaagagggttggtgccagaagccccccatggcgagtgctggggcccggcggtgccctgggggagcagatggggccacccctggcagggccgctacaaccttttccagcagcggagccctctggggggcctgtgcttgtggcatctctgagggcccagattgcacaaggtgacctggccgtggcctgagggtggagtcgcccagcacgcaggccggggcgctgcggggctaagtattaggccttcccagggagggggcgtgccaagcatcccagagccgggctgggaccgccaaaacgtcgtggcctggatcctctgggtctgagtgcctgatcccctgccccccaaaaaagcagaggtaggtgttgcaggcccagggcaggggtgcctgccccaggagagtcccaggcagtggttctcgtgccagtggcacccaggggcaaggacagccaacccccacccttgccacgtgtggggccacgtgggcatgtggggtgtgtgtttttaccttggtgaatctcacctgccaacgatttctcgtgagtgccgaccaccttctccgaccatgttacgcccgggcggcagcagcccccggccactgcaaacccatgccctgggtcccccggctcccccagggaggcatccccgtgccaatgtcccccagtggtggcagcagatcctgtggccggcctggcggacgggacccagtgatacttgtatattacacagtcctgatttcagacaatttcaaccttaatctatttaaaaaagaatattctatacaagctgtttttaagccttttaccatttgaaatgcatgtgttgtgcgcgttggggatgggaggaggggctgaggagcggctcagtgtcacctcccacagccaccggccctgacccttaatccagacaccgatggaagtcgacttttcatatctttctcctgaaatgaactctgttttaaattggaataaattttgttcctaaatgc

SEQ ID NO: 320388 - DNA, 1059 bp, Homo sapiens
ggctaggtagcgaggctgggtttgcacttctgtctcacccggaagcgtcctttttttgtgccaggtgtctacctaagagggttggtgccagaagccccccatggcgagtgctggggcccggcggtgccctgggggagcagatggggccacccctggcagggccgctacaaccttttccagcagcggagccctctggggggcctgtgcttgtggcatctctgagggcccagattgcacaaggtgacctggccgtggcctgagggtggagtcgcccagcacgcaggccggggcgctgcggggctaagtattaggccttcccagggagggggcgtgccaagcatcccagagccgggctgggaccgccaaaacgtcgtggcctggatcctctgggtctgagtgcctgatcccctgccccccaaaaaagcagaggtaggtgttgcaggcccagggcaggggtgcctgccccaggagagtcccaggcagtggttctcgtgccagtggcacccaggggcaaggacagccaacccccacccttgccacgtgtggggccacgtgggcatgtggggtgtgtgtttttaccttggtgaatctcacctgccaacgatttctcgtgagtgccgaccaccttctccgaccatgttacgcccgggcggcagcagcccccggccactgcaaacccatgccctgggtcccccggctcccccagggaggcatccccgtgccaatgtcccccagtggtggcagcagatcctgtggccggcctggcggacgggacccagtgatacttgtatattacacagtcctgatttcagacaatttcaaccttaatctatttaaaaaagaatattctatacaagctgtttttaagccttttaccatttgaaatgcatgtgttgtgcgcgttggggatgggaggaggggctgaggagcggctcagtgtcacctcccacagccaccggccctgacccttaatccagacaccgatggaagtcgacttttcatatctttctcctgaaatgaactctgttttaaattggaataaattttgttcctaaatgc

SEQ ID NO: 320389 - DNA, 975 bp, Homo sapiens
gccctcggccccgggccggcccgccccgcctcggccgccgcctggcgagccgccgggtccccgctcggccggtggccgaggccggagggccgcggcgggcggcggccgaggcggctccggccagggccgggccgggggccggggggcggcggcgggcaggcggccgcgtcggccggggccgggacgatgactctggagtccatgatggcgtgttgcctgagcgatgaggtgaaggagtccaagcggatcaacgccgagatcgagaagcagctgcggcgggacaagcgcgacgcccggcgcgagctcaagctgctgctgctcggcacgggcgagagcgggaagagcacgttcatcaagcagatgcgcatcatccacggcgccggctactcggaggaggacaagcgcggcttcaccaagctcgtctaccagaacatcttcaccgccatgcaggccatgatccgggccatggagacgctcaagatcctctacaagtacgagcagaacaaggccaatgcgctcctgatccgggaggtggacgtggagaaggtgaccaccttcgagcatcagtacgtcagtgccatcaagaccctgtgggaggacccgggcatccaggaatgctacgaccgcaggcgcgagtaccagctctccgactctgccaagtactacctgaccgacgttgaccgcatcgccaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagccagctacagaagaaactggggctcctccagggtggcagcaacaataaatagactcgcgac

SEQ ID NO: 320390 - DNA, 166 bp, Homo sapiens
tggttggcttcagcttctttcgtcttagctcaccacaggcgagcaccttgctggacgacatggtcttaccgaggagatgggggtgctggggtcttaccgaggagaccggggtggcggggcgttttggctacagcagtgctgttcccacctttggactttgtctgtt

SEQ ID NO: 320391 - DNA, 504 bp, Homo sapiens
agagagtgaatggtttgaatgaatacatcctaatttaagcattaaaaacatagttctctaacatttgatgttttgcattgtcatttccttagttatttttgttcatcccagctcttgagaatggctgaaataatgcaatttgtatttaaaaggctgtggcatttttctcatagcttttcaatataaagatttaaatcagttaaaggcagcagtggtgcccgtcacatgctagttagaggacaacttgggctgcaggagaaggagcaagatgacagcagagagggtgagaagctgggaggagagccagctttcaaggggtgagaatttgtgactaaagagctgagacttacatcctaaaaaacagccatcaagtttctgaagtggcaaacttaacccctggagatgatccaaggaagtgttagggacaaatcaccatgccttagaggaccacagaagttctcattgccagattatctccacattttcttttttaagcaaatctaa

SEQ ID NO: 320392 - DNA, 434 bp, Homo sapiens
cctgtactcaagagtcctagaggctttggacagtctctccagagacactggctgaccccacgcagggagggccaagctgctcacctggggctccctgccccatggggccaggtgcagtccacatccatcagggaccacctcacaagccccactctcttcttcccatcactggctcacgccatcatctcccctcatccggagctctgaagggctcaccgctacctccaggtgtatttgagccaaggcccgggagatgaggctgctcacccagctgtgcgctgagctgggacaaaagctctgggacctcagcacccagcaaagagggctgggagaaagctgacttataacgagtgcttgcactcattaaataagtgaatgaatggaagacagcaggcctcaaggggctgtcagggggttcagggacaagatacacg

SEQ ID NO: 320393 - DNA, 339 bp, Homo sapiens
  misc_feature (13)..(13): n is a, c, g, or t
tagtaatcaacgngttttattttcctagaactgaaatcatctacggttctcagagctaaacttccaaagctacagtcagcaatttttcatcagagcccaaggttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattac

SEQ ID NO: 320394 - DNA, 1226 bp, Homo sapiens
gagacagactttcgctcttgtcacccaggctggagtgcaatggaatgatcttggctcactgcaaacttcgccttccagggttcaagcgattctcctgcctcagcctccccagtagctgggattacaggcatgtgccaccacgccaggttcattttgtattttcagtagagactgggtttcatcgtgctggccaggctggtctcgaactcctgacctcaagtgttccacccacctcagccttcccaaagtgctgggattacaggcgtgacgaccaagcctggccaaccctctcgtctttcaggggcttaaataaatttgcttttctccccaaattctttgcccaccccatcagccagtttcaaagggtggagtgtaacgtgggttgcccaatcctgcttgccatgaagtacttagcttacagcagtttgccaggcgcagacaccatgctttatttctatttctacgaacaagaagcgtctcttgcagtctgcaatatttgtcgtcaaaaatttcactgggtgttgtatcaaatcagccacctgtatagaggtgtgatcgttgacaattttttgttacatcccgatggccgttttacctggaccattttcttcctttcatgggtgaagcaaaactccttggtagactttttttttgggacagagtctcgctctgtcgctctgttgcccaggctggagtgcagtggtgcgatgtcgaaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattacta

SEQ ID NO: 320395 - DNA, 818 bp, Homo sapiens
  misc_feature (2)..(2): n is a, c, g, or t
  misc_feature (28)..(28): n is a, c, g, or t
anggctaggtacgaggctgggtggctgngctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagttcttctcatccatttcctgactggcccttgtggtgtcccattgttgttccctgtggggccggcatttgtgccttccc

SEQ ID NO: 320396 - DNA, 830 bp, Homo sapiens
  misc_feature (22)..(22): n is a, c, g, or t
  misc_feature (28)..(28): n is a, c, g, or t
  misc_feature (790)..(790): n is a, c, g, or t
gaactacggctagtacgaggcngggttnaatcggccgagacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattactaaaaaaanaaaccggcctttgtgggggaaagggtgaggcaggaggtcg
